US012478617B2

(12) United States Patent
Neelamkavil et al.

(10) Patent No.: US 12,478,617 B2
(45) Date of Patent: Nov. 25, 2025

(54) LIPIDATED PEPTIDE INHIBITORS OF INTERLEUKIN-23 RECEPTOR

(71) Applicants: JANSSEN BIOTECH, INC., Horsham, PA (US); PROTAGONIST THERAPEUTICS, INC., Newark, CA (US)

(72) Inventors: Santhosh Neelamkavil, Spring House, PA (US); Chengzao Sun, Spring House, PA (US); Sandeep Somani, Spring House, PA (US); Stephanie A. Barros, Spring House, PA (US); Danila Branca, Pomezia (IT); Ashok Bhandari, Newark, CA (US); James Daniel, Newark, CA (US); Tran Trung Tran, Newark, CA (US); Brian Frederick, Newark, CA (US)

(73) Assignees: JANSSEN BIOTECH, INC., Horsham, PA (US); PROTAGONIST THERAPEUTICS, INC., Newark, CA (US)

(*) Notice: Subject to any disclaimer, the term of this patent is extended or adjusted under 35 U.S.C. 154(b) by 0 days.

(21) Appl. No.: 18/495,457

(22) Filed: Oct. 26, 2023

(65) Prior Publication Data

US 2024/0173309 A1 May 30, 2024

Related U.S. Application Data

(63) Continuation of application No. PCT/US2022/037205, filed on Jul. 14, 2022.

(60) Provisional application No. 63/221,697, filed on Jul. 14, 2021.

(51) Int. Cl.
*A61K 31/4439* (2006.01)
*A61P 37/02* (2006.01)

(52) U.S. Cl.
CPC .......... *A61K 31/4439* (2013.01); *A61P 37/02* (2018.01)

(58) Field of Classification Search
CPC .................................................. A61K 31/4439
See application file for complete search history.

(56) References Cited

U.S. PATENT DOCUMENTS 4,684,620 A 8/1987 Hruby et al.
4,724,229 A 2/1988 Ali
5,192,746 A 3/1993 Lobl et al.
5,494,897 A 2/1996 Ishikawa et al.
5,569,741 A 10/1996 Coy et al.
5,990,084 A 11/1999 Richter et al.
6,087,334 A 7/2000 Beeley et al.
6,235,711 B1 5/2001 Dutta
6,818,617 B1 11/2004 Niewiarowski et al.
7,534,764 B2 5/2009 Ganz et al.
7,589,170 B1 9/2009 Smythe et al.
7,718,598 B1 5/2010 Smythe et al.
8,304,382 B2 11/2012 Ferreira et al.
8,313,950 B2 11/2012 Rovin et al.
8,435,941 B2 5/2013 Ganz et al.
8,536,140 B2 9/2013 Clandinin et al.
8,568,706 B2 10/2013 Grabstein et al.
8,796,418 B2 8/2014 Walensky et al.
8,946,150 B2 2/2015 Gallagher et al.
8,999,935 B2 4/2015 Huang
9,169,292 B2 10/2015 Gallagher et al.
9,273,093 B2 3/2016 Bhandari et al.
9,518,091 B2 12/2016 Bhandari et al.
9,605,027 B2 3/2017 Gallagher et al.
9,624,268 B2 4/2017 Bourne et al.
9,714,270 B2 7/2017 Bhandari et al.
9,809,623 B2 11/2017 Bhandari et al.
9,822,157 B2 11/2017 Smythe et al.
10,023,614 B2 7/2018 Bhandari et al.
10,030,061 B2 7/2018 Smythe et al.
10,035,824 B2 7/2018 Bhandari et al.
10,059,744 B2 8/2018 Bhandari et al.
10,196,424 B2 2/2019 Bourne et al.
10,278,957 B2 5/2019 Anandan et al.
10,301,371 B2 5/2019 Bhandari et al.
10,407,468 B2 9/2019 Bhandari et al.
10,442,846 B2 10/2019 Smythe et al.
10,501,515 B2 12/2019 Vink et al.
(Continued)

FOREIGN PATENT DOCUMENTS

CA 2015761 A1 11/1990
CN 101307085 A 11/2008
(Continued)

OTHER PUBLICATIONS

Liu, Shuang, "Radiolabeled Multimeric Cyclic RGD Peptides as Integrin Alphavbeta3 Targeted Radiotracers for Tumor Imaging" School of Health Science, Purdue University, Molecular Pharmaceutics (2006); 3(5):472-487.
International Search Report and Written Opinion for International Application No. PCT/US2022/037205 mailed Jan. 12, 2023, 25 pages.
Adams and Macmillan, "Investigation of peptide thioester formation via N->Se acyl transfer." Journal of Peptide Science (2013); 19 (2): 65-73.
Andreu, et al., "Formation of Disulfide Bonds in Synthetic Peptides and Proteins" Ch. 7 in Synthetic Peptides and Proteins. In: Pennington M.W., Dunn B.M. (eds) Peptide Synthesis Protocols. Methods in Molecular Biology (1994); 35: 91-169.
(Continued)

*Primary Examiner* — John S Kenyon
*Assistant Examiner* — Rehana Ismail
(74) *Attorney, Agent, or Firm* — Lathrop GPM LLP; Brian C. Trinque

(57) ABSTRACT

The present invention relates to novel lipidated peptide inhibitors of the interleukin-23 receptor (IL-23R) or pharmaceutically acceptable salts, solvates and/or other forms thereof, corresponding pharmaceutical compositions, methods and/or uses of the IL-23R inhibitors for treatment of autoimmune inflammation diseases and/or related disorders.

40 Claims, No Drawings

Specification includes a Sequence Listing.

(56) References Cited

U.S. PATENT DOCUMENTS

| | | | |
|---|---|---|---|
| 10,626,146 | B2 | 4/2020 | Bhandari et al. |
| 10,729,676 | B2 | 8/2020 | Anandan et al. |
| 10,787,490 | B2 | 9/2020 | Bhandari et al. |
| 10,941,183 | B2 | 3/2021 | Bhandari et al. |
| 11,041,000 | B2 | 6/2021 | Bhandari et al. |
| 11,111,272 | B2 | 9/2021 | Bhandari et al. |
| 11,845,808 | B2 | 12/2023 | Sun et al. |
| 2003/0166138 | A1 | 9/2003 | Kinsella et al. |
| 2003/0166514 | A1 | 9/2003 | Jones et al. |
| 2004/0052785 | A1 | 3/2004 | Goodman et al. |
| 2004/0123343 | A1 | 6/2004 | La Rosa et al. |
| 2004/0176293 | A1 | 9/2004 | Peterson et al. |
| 2006/0166881 | A1 | 7/2006 | Hotchkiss et al. |
| 2006/0183884 | A1 | 8/2006 | Blaschuk et al. |
| 2007/0032417 | A1 | 2/2007 | Baell |
| 2007/0166308 | A1 | 7/2007 | Pullen et al. |
| 2007/0191272 | A1 | 8/2007 | Stemmer et al. |
| 2007/0197430 | A1 | 8/2007 | Baell et al. |
| 2008/0019913 | A1 | 1/2008 | Polt et al. |
| 2008/0213277 | A1 | 9/2008 | Sasu et al. |
| 2008/0260820 | A1 | 10/2008 | Borrelly et al. |
| 2008/0300180 | A1 | 12/2008 | Schambye et al. |
| 2009/0053819 | A1 | 2/2009 | Seymour et al. |
| 2009/0170143 | A1 | 7/2009 | Uttenthal et al. |
| 2009/0257952 | A1 | 10/2009 | Cochran et al. |
| 2010/0151487 | A1 | 6/2010 | Rovin et al. |
| 2010/0183617 | A1 | 7/2010 | Herr et al. |
| 2010/0190710 | A1 | 7/2010 | Chemtob et al. |
| 2010/0196441 | A1 | 8/2010 | Sondermeijer et al. |
| 2010/0272731 | A1 | 10/2010 | Presta et al. |
| 2010/0280098 | A1 | 11/2010 | Juliano et al. |
| 2011/0059087 | A1 | 3/2011 | Lewis et al. |
| 2011/0086024 | A1 | 4/2011 | Arthos et al. |
| 2011/0118186 | A1 | 5/2011 | Schteingart et al. |
| 2011/0142889 | A1 | 6/2011 | Lee et al. |
| 2011/0212104 | A1 | 9/2011 | Beaumont et al. |
| 2011/0282029 | A1 | 11/2011 | Holmes et al. |
| 2012/0021975 | A1 | 1/2012 | Hoffmann et al. |
| 2012/0040894 | A1 | 2/2012 | Ganz et al. |
| 2012/0071422 | A1 | 3/2012 | Gallagher et al. |
| 2012/0115930 | A1 | 5/2012 | Monia et al. |
| 2013/0029907 | A1 | 1/2013 | Gallagher et al. |
| 2013/0137123 | A1 | 5/2013 | Cucchiara et al. |
| 2013/0172272 | A1 | 7/2013 | Gallagher et al. |
| 2013/0183755 | A1 | 7/2013 | Gallagher et al. |
| 2013/0310303 | A1 | 11/2013 | Eldar-Finkelman et al. |
| 2013/0338132 | A1 | 12/2013 | Koshiba et al. |
| 2014/0005128 | A1 | 1/2014 | Mo et al. |
| 2014/0193465 | A1 | 7/2014 | Bhandari et al. |
| 2014/0286953 | A1 | 9/2014 | Sasu et al. |
| 2014/0294901 | A1 | 10/2014 | Bhandari et al. |
| 2014/0294902 | A1 | 10/2014 | Bhandari et al. |
| 2014/0336110 | A1 | 11/2014 | Ganz et al. |
| 2015/0056301 | A1 | 2/2015 | Kawabe et al. |
| 2015/0118315 | A1 | 4/2015 | Wilson |
| 2015/0157692 | A1 | 6/2015 | Fu |
| 2015/0203555 | A1 | 7/2015 | Gellman et al. |
| 2015/0284429 | A1 | 10/2015 | Merutka |
| 2016/0031944 | A1 | 2/2016 | Bhandari et al. |
| 2016/0039878 | A1 | 2/2016 | Gallagher et al. |
| 2016/0145306 | A1 | 5/2016 | Bourne et al. |
| 2016/0152664 | A1 | 6/2016 | Bhandari et al. |
| 2016/0159862 | A1 | 6/2016 | Bhandari et al. |
| 2016/0199437 | A1 | 7/2016 | Wilson |
| 2016/0222076 | A1 | 8/2016 | Smythe et al. |
| 2016/0228491 | A1 | 8/2016 | Wilson |
| 2016/0368966 | A1 | 12/2016 | Bhandari et al. |
| 2017/0313754 | A1 | 11/2017 | Bourne et al. |
| 2017/0327541 | A1 | 11/2017 | Bhandari et al. |
| 2018/0022778 | A1 | 1/2018 | Bourne et al. |
| 2018/0079782 | A1 | 3/2018 | Bhandari et al. |
| 2018/0079783 | A1 | 3/2018 | Bhandari et al. |
| 2018/0099995 | A1 | 4/2018 | Bhandari et al. |
| 2018/0100004 | A1 | 4/2018 | Smythe et al. |
| 2018/0105572 | A1 | 4/2018 | Bhandari et al. |
| 2018/0148477 | A1 | 5/2018 | Bhandari et al. |
| 2019/0002500 | A1 | 1/2019 | Bhandari et al. |
| 2019/0002503 | A1 | 1/2019 | Bourne et al. |
| 2019/0016756 | A1 | 1/2019 | Bhandari et al. |
| 2019/0076400 | A1 | 3/2019 | Anandan et al. |
| 2019/0185535 | A1 | 6/2019 | Smythe et al. |
| 2019/0185536 | A1 | 6/2019 | Smythe et al. |
| 2019/0231746 | A1 | 8/2019 | Anandan et al. |
| 2019/0248870 | A1 | 8/2019 | Bhandari et al. |
| 2019/0264197 | A1 | 8/2019 | Barkan et al. |
| 2019/0270786 | A1 | 9/2019 | Bhandari et al. |
| 2019/0300590 | A1* | 10/2019 | Bhandari .................. A61P 1/04 |
| 2019/0337983 | A1 | 11/2019 | Bhandari et al. |
| 2020/0017549 | A1 | 1/2020 | Bhandari et al. |
| 2020/0017566 | A1 | 1/2020 | Bourne et al. |
| 2020/0040037 | A1 | 2/2020 | Bhandari et al. |
| 2020/0064357 | A1 | 2/2020 | Cheng et al. |
| 2020/0207822 | A1 | 7/2020 | Bhandari et al. |
| 2020/0239516 | A1 | 7/2020 | Richelle et al. |
| 2020/0239523 | A1 | 7/2020 | Bhandari et al. |
| 2020/0308229 | A1 | 10/2020 | Bhandari et al. |
| 2020/0361992 | A1 | 11/2020 | Bourne et al. |
| 2021/0009638 | A1 | 1/2021 | Bhandari et al. |
| 2021/0061872 | A1 | 3/2021 | Liu et al. |
| 2021/0147483 | A1 | 5/2021 | Bourne et al. |
| 2021/0363185 | A1 | 11/2021 | Bhandari et al. |
| 2021/0371466 | A1 | 12/2021 | Bhandari et al. |
| 2022/0041658 | A1 | 2/2022 | Bhandari |
| 2022/0177532 | A1 | 6/2022 | Di Pretoro et al. |
| 2022/0185846 | A1 | 6/2022 | Manthati et al. |
| 2022/0251142 | A1 | 8/2022 | Bhandari et al. |
| 2022/0348626 | A1 | 11/2022 | Smythe et al. |
| 2022/0372099 | A1 | 11/2022 | Liu et al. |
| 2022/0402983 | A1 | 12/2022 | Sun et al. |
| 2023/0129095 | A1 | 4/2023 | Bhandari et al. |

FOREIGN PATENT DOCUMENTS

| | | | |
|---|---|---|---|
| CN | 101358201 | A | 2/2009 |
| DE | 10107707 | A1 | 8/2002 |
| JP | 2011231085 | A | 11/2011 |
| JP | 2016521257 | A | 7/2016 |
| JP | 2017530090 | A | 10/2017 |
| WO | WO-9217492 | A1 | 10/1992 |
| WO | WO-9411018 | A1 | 5/1994 |
| WO | WO-9617617 | A1 | 6/1996 |
| WO | WO-9725351 | A2 | 7/1997 |
| WO | WO-9808871 | A1 | 3/1998 |
| WO | WO-9833524 | A1 | 8/1998 |
| WO | WO-9902194 | A1 | 1/1999 |
| WO | WO-9926615 | A1 | 6/1999 |
| WO | WO-0006243 | A2 | 2/2000 |
| WO | WO-0009560 | A1 | 2/2000 |
| WO | WO-0018789 | A1 | 4/2000 |
| WO | WO-0018790 | A1 | 4/2000 |
| WO | WO-0023474 | A1 | 4/2000 |
| WO | WO-0055119 | A1 | 9/2000 |
| WO | WO-0055184 | A1 | 9/2000 |
| WO | WO-0061580 | A1 | 10/2000 |
| WO | WO-0168586 | A2 | 9/2001 |
| WO | WO-03066678 | A1 | 8/2003 |
| WO | WO-2004011650 | A2 | 2/2004 |
| WO | WO-2004092405 | A2 | 10/2004 |
| WO | WO-2006032104 | A1 | 3/2006 |
| WO | WO-2007138291 | A2 | 12/2007 |
| WO | WO-2008097461 | A2 | 8/2008 |
| WO | WO-2008101017 | A2 | 8/2008 |
| WO | WO-2008134659 | A2 | 11/2008 |
| WO | WO-2008140602 | A2 | 11/2008 |
| WO | WO-2009002947 | A2 | 12/2008 |
| WO | WO-2009027752 | A2 | 3/2009 |
| WO | WO-2010065815 | A2 | 6/2010 |
| WO | WO-2010116752 | A1 | 10/2010 |
| WO | WO-2010124874 | A1 | 11/2010 |
| WO | WO-2011091357 | A1 | 7/2011 |
| WO | WO-2011149942 | A2 | 12/2011 |
| WO | WO-2012052205 | A1 | 4/2012 |
| WO | WO-2013086143 | A1 | 6/2013 |
| WO | WO-2014059213 | A1 | 4/2014 |

(56) References Cited

FOREIGN PATENT DOCUMENTS

| | | | |
|---|---|---|---|
| WO | WO-2014127316 | A2 | 8/2014 |
| WO | WO-2014145561 | A2 | 9/2014 |
| WO | WO-2014165448 | A1 | 10/2014 |
| WO | WO-2014210056 | A1 | 12/2014 |
| WO | WO-2015054500 | A2 | 4/2015 |
| WO | WO-2015157283 | A1 | 10/2015 |
| WO | WO-2015176035 | A1 | 11/2015 |
| WO | WO-2015183963 | A2 | 12/2015 |
| WO | WO-2015200916 | A2 | 12/2015 |
| WO | WO-2016004093 | A2 | 1/2016 |
| WO | WO-2016011208 | A1 | 1/2016 |
| WO | WO-2016054411 | A1 | 4/2016 |
| WO | WO-2016054445 | A1 | 4/2016 |
| WO | WO-2016109363 | A1 | 7/2016 |
| WO | WO-2016115168 | A1 | 7/2016 |
| WO | WO-2016195663 | A1 | 12/2016 |
| WO | WO-2016200364 | A1 | 12/2016 |
| WO | WO-2017011820 | A2 | 1/2017 |
| WO | WO-2017117411 | A1 | 7/2017 |
| WO | WO-2017165676 | A1 | 9/2017 |
| WO | WO-2018022917 | A1 | 2/2018 |
| WO | WO-2018022937 | A1 | 2/2018 |
| WO | WO-2018089693 | A2 | 5/2018 |
| WO | WO-2018136646 | A1 | 7/2018 |
| WO | WO-2019051494 | A1 | 3/2019 |
| WO | WO-2019157268 | A1 | 8/2019 |
| WO | WO 2019/246313 | A9 | 12/2019 |
| WO | WO-2019246273 | A1 | 12/2019 |
| WO | WO-2019246349 | A1 | 12/2019 |
| WO | WO-2020014646 | A1 | 1/2020 |
| WO | WO-2020198682 | A1 | 10/2020 |
| WO | WO-2021007433 | A1 | 1/2021 |
| WO | WO-2021046246 | A1 | 3/2021 |
| WO | WO 2021/146441 | A1 | 7/2021 |
| WO | WO-2021142373 | A1 | 7/2021 |
| WO | WO-2021146454 | A1 | 7/2021 |
| WO | WO-2021146458 | A1 | 7/2021 |
| WO | WO-2022026629 | A1 | 2/2022 |
| WO | WO-2022026631 | A1 | 2/2022 |
| WO | WO-2022026633 | A1 | 2/2022 |
| WO | WO-2022109328 | A1 | 5/2022 |
| WO | WO-2022212696 | A1 | 10/2022 |
| WO | WO-2022212698 | A1 | 10/2022 |
| WO | WO-2022212700 | A2 | 10/2022 |
| WO | WO-2022266060 | A1 | 12/2022 |
| WO | WO-2023288017 | A2 | 1/2023 |
| WO | WO-2023288019 | A2 | 1/2023 |
| WO | WO-2023288028 | A2 | 1/2023 |

OTHER PUBLICATIONS

Annis, et al., "[10] Disulfide bond formation in peptides". Methods Enzymol. (1997); 289: 198-221.

Ashby, et al., "Plasma hepcidin levels are elevated but responsive to erythropoietin therapy in renal disease." Kidney International (2009); 75 (9): 976-981.

Balasubramanian and Kuppuswamy, "RGD-containing Peptides Activate S6K1 through 3 Integrin in Adult Cardiac Muscle Cells", J Biol Chem. (Oct. 24, 2003); 278(43): 42214-42224. Epub Aug. 9, 2003.

Boer, J., et al., "Design and Synthesis of Potent and Selective 47 Integrin Antagonists." J. Med. Chem. (2001); 44 (16): 2586-2592.

Bowie, J. U. et al., "Deciphering the message in protein sequences: Tolerance to amino acid substitutions," Science, (Mar. 16, 1990), 247(4948):1306-1310.

Brayden, D.J., and Mrsny, R.J., "Oral peptide delivery: prioritizing the leading technologies". Therapeutic Delivery (2011); 2(12): 1567-1573.

Chang, et al., Role of disulfide bonds in the structure and activity of human insulin. Mol Cells (Dec. 2003); 16(3): 323-330.

Chatterjee, Jayanta, et al., "N-Methylation of Peptides: A New Perspective in Medicinal Chemistry", Accounts of Chemical Research (2008); 41(10): 1331-1342.

Cheng et al., "The Biomarker Profile of PTG-200, an Oral Peptide Antagonist of IL-23 Receptor, Tracks with Efficacy in a Preclinical Model of IBD". Gastroenterology, AGA Abstracts, vol. 152, Issue 5, Supplement 1, S31, Apr. 1, 2017.

Chermahini et al., "Cyclic peptide nanocapsule as ion carrier for halides: a theoretical survey", Structural Chemistry (Oct. 2018); 29(5): 1351-1357.

Cherry, et al., "Vedolizumab: an α4ß747 integrin antagonist for ulcerative colitis and Crohn's disease." Ther Adv Chronic Dis. (2015); 6(5): 224-233.

Clark, et al., "The Engineering of an Orally Active Conotoxin for the Treatment of Neuropathic Pain." Angew Chem Int Ed (Sep. 2010); 49: 6545-6548.

Clark, et al., "Understanding the Structure/Activity Relationships of the Iron Regulatory Peptide Hepcidin." Chem Biol. (Mar. 2011); 18(3): 336-343.

Clark, Richard J., et al. "Design, synthesis, and characterization of cyclic analogues of the iron regulatory peptide hormone hepcidin." Peptide Science (2013); 100.5: 519-526.

Craik, et al., "Potential therapeutic applications of the cyclotides and related cystine knot mini-proteins." Expert Opin Investig Drugs (May 2007); 16(5): 595-604.

"Crushing Guide for Oral Medication in Residential Aged Care", Waitemata District Health Board, 2011, 2 pages.

Database EPO Proteins [Online] Dec. 3, 2010 (Dec. 3, 2010), "Sequence from Patent WO2010124874." XP002761649, retrieved from EBI accession No. EPOP:HI656765 Database accession No. HI656765, 1 page.

Database USPTO Proteins [Online] Dec. 17, 2012 (Dec. 17, 2012), "Sequence from U.S. Pat. No. 8,313,950.", XP002761650, retrieved from EBI accession No. USPOP:AGA36544 Database accession No. AGA36544, 1 page.

Davies, J.S., "The Cyclization of Peptides and Depsipeptides", J Pept Sci. (Aug. 2003); 9(8): 471-501.

De Mast, et al., "Increased serum hepcidin and alterations in blood iron parameters associated with asymptomatic P. falciparum and P. vivax malaria." Haematologica (2010); 95 (7): 1068-1074.

De Vega, et al., "Modulation of Protein-Protein Interactions by Stabilizing/Mimicking Protein Secondary Structure Elements." Curr Top Med Chem (2007); 7(1): 33-62.

Definition of Isostere, Medical Definition and More from Merriam-Webster Dictionary, www.merriam-webster.com/medical/isostere accessed on Feb. 5, 2015, 3 pages.

Delgado et al., "The uses and properties of PEG-linked proteins". Critical Reviews in Therapeutic Drug Carrier Systems (Jan. 1, 1992); 9(3-4): 249-304.

Desbenoit, N., et al. "Reversible metalation of a bis-disulfide analogue of the Cys*-X-Cys* hepcidin binding site: structural characterisation of the related copper complex]." Annales Pharmaceutiques Francaises (2010); 68(6): 388-396. (with English summary).

Dolain, Christel, et al. "Inducing -Helices in Short Oligopeptides through Binding by an Artificial Hydrophobic Cavity." Journal of the American Chemical Society (2010); 132.16: 5564-5565.

Dubree, Nathan J.P. et al., "Selective 47 Integrin Antagonists and Their Potential as Antiinflammatory Agents", J. Med. Chem., 45: 3451-3457 (2002).

Dutta, Anand S., "Potent Cyclic Monomeric and Dimeric Peptide Inhibitors of VLA-4 (a4b1 Integrin)-Mediated Cell Adhesion Based on the lle-Leu-Asp-Val Tetrapeptide", J. Peptide Sci. (2000); 6: 321-341.

Dutton, et al., "A New Level of Conotoxin Diversity, a Non-native Disulfide Bond Connectivity in -Conotoxin AulB Reduces Structural Definition but Increases Biological Activity." J Biol Chem (Oct. 2002); 277(50): 48849-48857.

Fass, D., "Disulfide bonding in protein biophysics." Annu Rev Biophys (2012); 41: 63-79. Epub Dec. 20, 2011.

Fosgerau and Hoffman, "Peptide therapeutics: current status and future directions." Drug Discovery Today (2015); 20(1): 122-128.

Foster "Deuterium Isotope Effects in Studies of Drug Metabolism", Trends Pharmacol. Sci. (1984); 5(12): 524-527.

Francis, G., et al., "PEGylation of Cytokines and other Therapeutic Proteins and Peptides: the Importance of Biological Optimisation of

(56) References Cited

OTHER PUBLICATIONS

Coupling Techniques," International Journal of Hematology, Jul. 1998, vol. 68, pp. 1-18, 19 pages.
Frese et al., "Modular Combination of Enzymatic Halogenation of Tryptophan with Suzuki—Miyaura Cross-Coupling Reactions." ChemCatChem. May 20, 2016, vol. 8, No. 10, pp. 1799-1803.
Ganz and Nemeth, "Hepcidin and iron homeostasis." Biochimica et Biophysica Acta (BBA)—Molecular Cell Research (Sep. 2012); 1823 (9): 1434-1443.
Garcia, Josep et al., "D-Polyarginine Lipopeptides as Intestinal Permeation Enhancers". ChemMedChem Oct. 8, 2018; 13(19): 2045-2052. Epub Aug. 20, 2018.
Gee et al. "Cyclic Peptides as Non-carboxyl-terminal Ligands of Syntrophin PDZ Domains," The Journal of Biological Chemistry, 273(34): 21980-21987 (1998).
Gentilucci, et al., "Chemical Modifications Designed to Improve Peptide Stability: Incorporation of Non-Natural Amino Acids, Pseudo-Peptide Bonds, and Cyclization". Curr Pharm Des. (2010); 16(28): 3185-3203.
Girelli, Domenico, et al. "Hepcidin in the diagnosis of iron disorders." Blood (2016); 127.23 : 2809-2813.
Gombotz and Pettit, "Biodegradable Polymers for Protein and Peptide Drug Delivery". Bioconjugate Chem. (Jul. 1, 1995); 6(4): 332-351.
Görmer, et al., "Efficient Microwave-Assisted Synthesis of Unsymmetrical Disulfides", J. Org. Chem. (Feb. 1, 2010); 75(5): 1811-1813.
Gruschow, et al., "New pacidamycin antibiotics through precursor-directed biosynthesis". Chembiochem. Jan. 26, 2009; 10(2): 355-360.
Guerler and Knapp, "Novel protein folds and their nonsequential structural analogs." Protein Sci (Aug. 2008); 17(8): 1374-1382.
Guharoy and Chakrabarti, "Secondary structure based analysis and classification of biological interfaces: identification of binding motifs in protein-protein interactions." Bioinformatics (2007); 23(15): 1909-1918. Epub May 17, 2007.
Gupta, et al., "A classification of disulfide patterns and its relationship to protein structure and function." Protein Sci (Aug. 2004); 13(8): 2045-2058.
Haanstra, et al., "Antagonizing the a4B1 Integrin, but no a4B7, Inhibits Leukocytic Infiltration of the Central Nervous System in Rhesus Monkey Experimental Autoimmune Encephalomyelitis", Journal of Immunology, 90(5): 1961-1973 (2013).
Hartig, et al., "Intramolecular disulphide bond arrangements in nonhomologous proteins." Protein Sci Publ Protein Soc (Feb. 2005); 14(2): 474-482.
Hawe, et al., "Forced degradation of therapeutic proteins." J Pharm Sci. (Mar. 2012); 101(3): 895-913. Epub Nov. 14, 2011.
Henikoff and Henikoff, "Amino acid substitution matrices from protein blocks." Proc Natl Acad Sci U S A (Nov. 1992); 89(Nov.); 10915-10919.
Hruby and Bonner, "Design of Novel Synthetic Peptides Including Cyclic Conformationally and Topographically Constrained Analogs". Methods in Molecular Biology, Ch. 11, vol. 35 Peptide Synthesis Protocols, Edited by M.W Pennington and B. M. Dunn Copyright, 1994 Humana Press Inc, Totowa, NJ, pp. 201-241, 40 pages.
https://medlineplus.gov/druginfo/meds/a682145.html. Accessed Dec. 22, 2022 (Year: 2022), 7 pages.
https://www.cdc.gov/diabetes/basics/what-is-type-1-diabetes.html. Accessed Dec. 22, 2022 (Year: 2022), 4 pages.
https://www.rheumatology.org/I-Am-A/Patient-Caregiver/Diseases-Conditions/Psoriatic-Arthritis. Accessed Dec. 22, 2022 (Year: 2022), 3 pages.
Hudecz, et al., "Synthesis, conformation, biodistribution and in vitro cytotoxicity of daunomycin-branched polypeptide conjugates". Bioconjugate Chem. (Jan. 1, 1992); 3(1): 49-57.
Ilyin, Gennady, et al. "Comparative analysis of mouse hepcidin 1 and 2 genes: evidence for different patterns of expression and inducibility during iron overload 1." FEBS Letters (2003); 542.1-3: 22-26.
Jackson, D.Y., "Alpha 4 integrin antagonists." Current Pharmaceutical Design, (8)14: 1229-1253 (2002).
Janssen et al., "Comparison of a Monomeric and Dimeric Radiolabeled RGD-Peptide for Tumor Targeting", Cancer Biotherapy and Radiopharmaceuticals, 17(6): 641-646 (2002).
Jordan, John B., et al., "Hepcidin revisited, disulfide connectivity, dynamics, and structure", Journal of Biological Chemistry (2009); 284(36): 24155-24167.
Kelleman, A. et al., "Incorporation of thioether building blocks into an v3-specific RGD peptide: Synthesis and biological activity", Biopolymers (Peptide Science), 71(6): 686-695 (2003).
Kitazume and Yamazaki, Experimental Methods in Organic Fluorine Chemistry, Gordon and Breach Science Publishers, 1998, p. 9, 3 pages.
Kluskens, L.D. et al., "Angiotensin-(1-7) with Thioether Bridge: An Angiotensin-Converting Enzyme-Resistant, Potent Angiotensin-(1-7) Analog", The Journal of Pharmacology and Experimental Therapeutics, 328(3): 849-855 (2009).
Knudsen, Lotte B., et al. "Potent derivatives of glucagon-like peptide-1 with pharmacokinetic properties suitable for once daily administration." Journal of Medicinal Chemistry (2000); 43.9: 1664-1669.
Krause, Alexander, et al. "LEAP 1, a novel highly disulfide bonded human peptide, exhibits antimicrobial activity." FEBS Letters (2000); 480.2-3: 147-150.
Kuchař, et al., "Human interleukin-23 receptor antagonists derived from an albumin-binding domain scaffold inhibit IL-23-dependent ex vivo expansion of IL-17-producing T-cells". Proteins (Jun. 2014); 82(6): 975-989. Epub Nov. 23, 2013.
Legge and Morieson, "On the prediction of partition coefficients and RF values of peptides." Aust. J. Biol. Sci. (1964); 17: 561-571.
Ley, Klaus, et al. "Integrin-based therapeutics: biological basis, clinical use and new drugs." Nature Reviews Drug Discovery (2016); 15.3: 173-183.
Li and Roller, "Cyclization Strategies in Peptide Derived Drug Design." Curr. Topics Med. Chem. (2002); 2: 325-341.
Liu and Wang, "Endomorphins: potential roles and therapeutic indications in the development of opioid peptide analgesic drugs". Med Res Rev. (May 2012); 32(3): 536-580. Epub Feb. 1, 2011.
Liu, Shuang, "Radiolabeled Cyclic RGD Peptides as Integrin v3-Targeted Radiotracers: Maximizing Binding Affinity via Bivalency." Bioconjugate Chem. (2009); 20 (12): 2199-2213.
Liu, Shuang, "Radiolabeled Multimeric Cyclic Rgd Peptides as Integrin Alphavbeta3 Targeted Radiotracers For Tumor Imaging" School of Health Science, Purdue University, Molecular Pharmaceuticals (2006); 3(5):472-487.
Longobardo, et al., "ß-Casomorphins: substitution of phenylalanine with ß-homo-phenylalanine increases the μ-type opioid receptor affinity." Bioorganic & Medicinal Chemistry Letters (2000); 10(11): 1185-1188.
Longobardo, et al., "Incorporation of ß-amino acids in bioactive peptides: a ß-casomorphin case study." Peptides 2002, Abstract P A97, Proceedings of the European Peptide Symposium, 27th, Sorrento, Italy, Aug. 31-Sep. 6, 2002 (2002), 198-199.
Madsen, Kjeld, et al. "Structure- activity and protraction relationship of long-acting glucagon-like peptide-1 derivatives: importance of fatty acid length, polarity, and bulkiness." Journal of Medicinal Chemistry (2007); 50.24: 6126-6132.
Maeda, et al., "Conjugates of anticancer agents and polymers: advantages of macromolecular therapeutics in vivo". Bioconjugate Chem. (1992 Sep./Oct.); 3(5): 3511-362.
Maher, Sam et al., "Safety and efficacy of sodium caprate in promoting oral drug absorption: from in vitro to the clinic". Advanced Drug Delivery Reviews Dec. 17, 2009; 61 (15): 1427-1449. Epub Oct. 1, 2009.
Maher, Sam et al., "Application of Permeation Enhancers in Oral Delivery of Macromolecules: An Update". Pharmaceutics Jan. 19, 2019; 11 (1): 41,23 pages.

(56) References Cited

OTHER PUBLICATIONS

Makharia, Govind K., "Current and emerging therapy for celiac disease", Frontiers in Medicine (Mar. 2014); vol. 1, Article 6, pp. 1-11.
Muheem, Abdul et al., "A review on the strategies for oral delivery of proteins and peptides and their clinical perspectives". Saudi Pharmaceutical Journal Jul. 2016; 24(4):413-428. Epub Jun. 16, 2014.
Muñoz, Manuel, et al. "Disorders of iron metabolism. Part II: iron deficiency and iron overload." Journal of Clinical Pathology (2011); 64.4: 287-296.
NCBI Reference Sequence: NP_653302.2, "interleukin-23 receptor precursor [Homo sapiens]", Feb. 8, 2023, 4 pages.
Nemeth, Elizabeta, et al., "The N-terminus of hepcidin is essential for its interaction with ferroportin: structure-function study", Blood (2006); 107(1): 328-333.
Niederreiter, et al., "Anti-IL-12/23 in Crohn's Disease: Bench and Bedside." Curr Drug Targets (Nov. 2013); 14(12): 1379-1384.
Park, C.H., et al., "Hepcidin, a urinary antimicrobial peptide synthesized in the liver." J Biol Chem. (2001); 276(11): 7806-7810. Epub Dec. 11, 2000.
Parrow, et al., "Prospects for a hepcidin mimic to treat -thalassemia and hemochromatosis." Expert Review of Hematology (2011); 4 (3): 233-235.
Pattarawarapan, "Selective Formation of Homo- and Heterobivalent Peptidomimetics." J. Med. Chem. (Aug. 2003); 46 (17): 3565-3567.
PCT/US2015/040658, International Search Report and Written Opinion, mailed Oct. 28, 2015, 12 pages.
PCT/US2016/042680, International Search Report and Written Opinion, mailed Jan. 13, 2017, 12 pages.
PCT/US2018/014257, International Search Report and Written Opinion, mailed May 14, 2018, 13 pages.
PCT/US2019/041665, International Search Report and Written Opinion mailed Dec. 19, 2019, 16 pages.
PCT/US2020/041409, International Search Report and Written Opinion, mailed Dec. 3, 2020, 17 pages.
PCT/US2021/013463, International Search Report and Written Opinion mailed Jun. 3, 2021, 14 pages.
PCT/US2021/060183, International Search Report and Written Opinion mailed Mar. 25, 2022, 12 pages.
Pelton, J.T. et al., "Somatostatin Analogs with Affinity for Opiate Receptors in Rat Brain Binding Assay", Peptides, 6(Suppl 1): 159-163 (1985).
Preza, Gloria C., et al., "Minihepcidins are rationally designed small peptides that mimic hepcidin activity in mice and may be useful for the treatment of iron overload", The Journal of Clinical Investigation (2011); 121(12): 4880-4888.
Quiniou, et al., "Specific targeting of the IL-23 receptor, using a novel small peptide noncompetitive antagonist, decreases the inflammatory response". Am J Physiol Regul Integr Comp Physiol. (Nov. 15, 2014); 307(10): R1216-R1230. Epub Aug. 20, 2014.
Ramos, E., et al., "Minihepcidins prevent iron overload in a hepcidin-deficient mouse model of severe hemochromatosis." Blood (Nov. 2012); 120(18): 3829-3836. Epub Sep. 18, 2012.
Rivera, Seth, et al., "Synthetic hepcidin causes rapid dose-dependent hypoferremia and is concentrated in ferroportin-containing organs", Blood (2005); 106: 2196-2199.
Rostovtsev, et al., "A Stepwise Huisgen Cycloaddition Process: Copper(I)Catalyzed Regioselective "Ligation" of Azides and Terminal Alkynes". Angewandte Chemie Int. Ed. (Jul. 2, 2002); 41(14): 2596-2599.
Rubinstein and Niv, "Peptidic modulators of protein-protein interactions: Progress and challenges in computational design." Biopolymers (2009); 91(7): 505-513.
Savvatis, et al., "Interleukin-23 Deficiency Leads to Impaired Wound Healing and Adverse Prognosis After Myocardial Infarction", Circulation: Heart Failure, (2014); 7, 161-171.
Sasaki, et al., "D-Arg2-dermorphin tetrapeptide analogs: a potent and long-lasting analgesic activity after subcutaneous administration." Biochem Biophys Res Commun. (1984); 120 (1): 214-218.
Shahidi, Neal, et al. "Vedolizumab for the treatment of ulcerative colitis." Expert Opinion on Biological Therapy (2016); 16.1 : 129-135.
SID 24885660, National Center for Biotechnology Information, PubChem Substance Database; SID=24885660, 5 pages. https://pubchem.ncbi.nlm.nih.gov/substance/24885660, available date: Jul. 16, 2007, accessed Jul. 21, 2016.
Soler-Ferran and Briskin, "Integrin α4ß7 Antagonists: Activities, Mechanisms of Action and Therapeutic Prospects", Current Immunology Reviews (2012), 8(2): 118-134.
Speers, et al., "Activity-Based Protein Profiling in Vivo Using a Copper(I)-Catalyzed Azide-Alkyne [3 + 2] Cycloaddition". J. Am. Chem. Soc. (Mar. 28, 2003); 125(16): 4686-4687.
Tandara, Leida, and Salamunic, Ilza . "Iron metabolism: current facts and future directions." Biochemia Medica (2012); 22.3: 311-328.
Temming, K. et al. "Rational Design of RGD-Albumin Conjugates for targeted Delivery of the VEGF-R Kinase Inhibitor PTK787 to Angiogenic Endothelium", ChemMedChem, 1: pp. 1200-1203 (2006).
Thermo Electron Corporation, Technical Information, "N-terminal and C-terminal Amidation of Peptides", 2 pages (2004).
Thumshirn, G. et al., "Multimeric Cyclic RGD Peptides as Potential Tools for Tumor Targeting: Solid Phase Peptide Synthesis and Chemoselective Oxime Ligation", Chem. Eur. J., 9: 2717-2725 (2003).
TornØe, et al., "Peptidotriazoles on solid phase: [1,2,3]-triazoles by regiospecific copper(i)-catalyzed 1,3-dipolar cycloadditions of terminal alkynes to azides." J Org Chem. (May 3, 2002); 67(9): 3057-3064.
Tsukada, et al., "An Anti-a-Fetoprotein Antibody-Daunorubicin Conjugate With a Novel Poly-L-glutamic Acid Derivative as Intermediate Drug Carrier ". J. Natl. Cancer Inst. (Sep. 1984); 73(3): 721-729.
Tuvia, et al., "A Novel Suspension Formulation Enhances Intestinal Absorption of Macromolecules Via Transient and Reversible Transport Mechanisms". Pharm Res. (Feb. 21, 2014); 31(8): 2010-2021.
Wang, et al., "Bioconjugation by Copper(I)-Catalyzed Azide-Alkyne [3 + 2] Cycloaddition". J Am Chem Soc. (Mar. 19, 2003); 125(11): 3192-3193.
White and Yudin, "Contemporary strategies for peptide macrocyclization." Nat Chem (Jun. 2011); 3(7): 509-524.
Witt, Dariusz, "Recent developments in disulfide bond formation". Synthesis (2008); 16: 2491-2509.
Xie, Youmei et al., "Nerve Growth Factor (NGF) Loop 4 Dimeric Mimetics Activate ERK and AKT and Promote NGF-like Neurotrophic Effects", The Journal of Biological Chemistry, 275(38): 29868-29874 (2000).
Yampolsky and Stoltzfus, "The Exchangeability of Amino Acids in Proteins", Genetics (Aug. 2005); 170(4): 1459-1472. Epub Jun. 8, 2005.
Yu and Gallagher, "A Naturally Occurring, Soluble Antagonist of Human IL-23 Inhibits the Development and In Vitro Function of Human Th17 Cells", The Journal of Immunology (2010); 185: 7302-7308.
Zalipsky, Samuel, "Functionalized Poly(ethylene glycols) for Preparation of Biologically Relevant Conjugates". Bioconjugate Chem. (1995); 6(2): 150-165.
IUPAC Commission on the Nomenclature of Organic Chemistry and IUPAC-IUB Commission on Biochemical Nomenclature, "Nomenclature of α-Amino Acids (Recommendations, 1974)," Biochemistry, 14(2):449-462 (1975).

* cited by examiner

LIPIDATED PEPTIDE INHIBITORS OF INTERLEUKIN-23 RECEPTOR

CROSS-REFERENCE TO RELATED APPLICATION

This application is a continuation of International Patent Application No. PCT/US2022/037205, filed Jul. 14, 2022, which claims the benefit under 35 U.S.C. § 119 of U.S. Provisional Patent Application Ser. No. 63/221,697, filed Jul. 14, 2021, which are herein incorporated by reference in their entirety, including their respective sequence listings.

PARTIES TO A JOINT RESEARCH AGREEMENT

The present disclosure was made by, or on behalf of, the below listed parties to a joint research agreement. The joint research agreement was in effect on or before the date the claimed invention was made, and the claimed invention was part of the joint research agreement and made as a result of activities undertaken within the scope of the joint research agreement. The parties to the joint research agreement are JANSSEN BIOTECH, INC. and PROTAGONIST THERAPEUTICS, INC.

INCORPORATION OF SEQUENCE LISTING

The sequence listing in ST.26 XML format entitled 745998_NTT-6598PCC0N_ST26.xml, created on Jan. 8, 2024, comprising 2,981,906 bytes, prepared according to 37 CFR 1.822 to 1.824, is incorporated herein by reference in its entirety.

FIELD OF THE INVENTION

The present invention relates to novel lipidated peptide inhibitors of the interleukin-23 receptor (IL-23R) or pharmaceutically acceptable salts, solvates and/or other forms thereof, invention relates to corresponding pharmaceutical compositions, methods and/or uses of the IL-23R inhibitors for treatment of autoimmune inflammation diseases and/or related disorders.

BACKGROUND

The interleukin-23 (IL-23) cytokine has been implicated as playing a crucial role in the pathogenesis of autoimmune inflammation and related diseases and disorders, such as multiple sclerosis, asthma, rheumatoid arthritis, psoriasis, and inflammatory bowel diseases (IBDs), for example, ulcerative colitis and Crohn's disease. Studies in acute and chronic mouse models of IBD revealed a primary role of interleukin-23 receptor (IL-23R) and downstream effector cytokines in disease pathogenesis. IL-23R is expressed on various adaptive and innate immune cells including Th17 cells, γδ T cells, natural killer (NK) cells, dendritic cells, macrophages, and innate lymphoid cells, which are found abundantly in the intestine. At the intestine mucosal surface, the gene expression and protein levels of IL-23R are found to be elevated in IBD patients. It is believed that IL-23 mediates this effect by promoting the development of a pathogenic CD4+ T cell population that produces IL-6, IL-17, and tumor necrosis factor (TNF).

Production of IL-23 is enriched in the intestine, where it is believed to play a key role in regulating the balance between tolerance and immunity through T-cell-dependent and T-cell-independent pathways of intestinal inflammation through effects on T-helper 1 (Th1) and Th17-associated cytokines, as well as restraining regulatory T-cell responses in the gut, favoring inflammation. In addition, polymorphisms in the IL-23 receptor (IL-23R) have been associated with susceptibility to inflammatory bowel diseases (IBDs), further establishing the critical role of the IL-23 pathway in intestinal homeostasis.

Psoriasis, a chronic skin disease affecting about 2%-3% of the general population has been shown to be mediated by the body's T cell inflammatory response mechanisms. IL-23 has one of several interleukins implicated as a key player in the pathogenesis of psoriasis, purportedly by maintaining chronic autoimmune inflammation via the induction of interleukin-17, regulation of T memory cells, and activation of macrophages. Expression of IL-23 and IL-23R has been shown to be increased in tissues of patients with psoriasis, and antibodies that neutralize IL-23 showed IL-23-dependent inhibition of psoriasis development in animal models of psoriasis.

IL-23 is a heterodimer composed of a unique p19 subunit and the p40 subunit shared with IL-12, which is a cytokine involved in the development of interferon-γ (IFN-γ)-producing T helper 1 ($T_H1$) cells. Although IL-23 and IL-12 both contain the p40 subunit, they have different phenotypic properties. For example, animals deficient in IL-12 are susceptible to inflammatory autoimmune diseases, whereas IL-23 deficient animals are resistant, presumably due to a reduced number of CD4+ T cells producing IL-6, IL-17, and TNF in the CNS of IL-23-deficient animals. IL-23 binds to IL-23R, which is a heterodimeric receptor composed of IL-12Rβ1 and IL-23R subunits. Binding of IL-23 to IL-23R activates the Jak-Stat signaling molecules, Jak2, Tyk2, and Stat1, Stat 3, Stat 4, and Stat 5, although Stat4 activation is substantially weaker and different DNA-binding Stat complexes form in response to IL-23 as compared with IL-12. IL-23R associates constitutively with Jak2 and in a ligand-dependent manner with Stat3. In contrast to IL-12, which acts mainly on naive CD4(+) T cells, IL-23 preferentially acts on memory CD4(+) T cells.

Therapeutic moieties that inhibit the IL-23 pathway have been developed for use in treating IL-23-related diseases and disorders. A number of antibodies that bind to IL-23 or IL-23R have been identified, including ustekinumab, which has been approved for the treatment of moderate to severe plaque psoriasis (PSO), active psoriatic arthritis (PSA), moderately to severely active Crohn's disease (CD) and moderately to severely active ulcerative colitis (UC).

Examples of such identified antibodies, include: Tildrakizumab, an anti-IL23 antibody approved for treatment of plaque psoriasis, Guselkumab, an anti-IL23 antibody approved for treatment of psoriatic arthritis and Risankizumab, an anti-IL23 antibody approved for the treatment of plaque psoriasis in the US, and generalized pustular psoriasis, erythrodermic psoriasis and psoriatic arthritis in Japan.

Although targeted IL-23 antibody therapeutics are used clinically, there are no small-molecule therapeutics that selectively inhibit IL-23 signaling. There are some identified polypeptide inhibitors that bind to IL-23R and inhibit binding of IL-23 to IL-23R (see, e.g., US Patent Application Publication No. US2013/0029907).

Lipidation of therapeutically useful polypeptides can offer advantageous physicochemical properties as compared to the corresponding unmodified polypeptides.

Lipidated polypeptides can exhibit improved half-life, reduced immunogenicity, enhanced intracellular uptake and/or enhanced delivery across epithelia.

Thus, there remains a significant need in the art for effective small-molecule and/or polypeptide therapeutic agents to treat and/or prevent IL-23-associated and/or IL23R-associated diseases and disorders, which include, but are not limited to, psoriasis, psoriatic arthritis, inflammatory bowel diseases, ulcerative colitis, and Crohn's disease. In particular:

- compounds and methods for specific targeting of IL-23R from the luminal side of the gut may provide therapeutic benefit to IBD patients suffering from local inflammation of the intestinal tissue; and/or
- orally bioavailable small molecule and/or polypeptide inhibitors of IL-23 may provide both a non-steroidal treatment option for patients with mild to moderate psoriasis psoriasis and treatment for moderate to severe psoriasis that does not require delivery by infusion.

Compounds and methods for specific targeting of the IL-23R from the luminal side of the gut may provide therapeutic benefit to IBD patients suffering from local inflammation of the intestinal tissue. In addition, orally bioavailable small molecule and/or polypeptide inhibitors of IL-23 may provide both a non-steroidal treatment option for patients with mild to moderate psoriasis and treatment for moderate to severe psoriasis that does not require delivery by infusion.

The present invention is directed to addressing these needs by providing lipidated cyclic peptide inhibitors or pharmaceutically acceptable salts, solvates and/or other forms thereof, that bind IL-23R to inhibit IL-23 binding and signaling, via different suitable routes of administration, which may include but is not limited to oral administration.

BRIEF SUMMARY

In general, the present invention relates to novel lipidated peptide inhibitors of the interleukin-23 receptor (IL-23R) or pharmaceutically acceptable salts, solvates and/or other forms thereof, corresponding pharmaceutical compositions, methods and/or uses of the IL-23R inhibitors for treatment of autoimmune inflammation diseases and/or related disorders.

inventionIn particular, the present invention relates to a compound of Formulas (I'), (I) to (X)), or pharmaceutically acceptable salts, solvates and/or other forms thereof, corresponding pharmaceutical compositions, methods and/or uses for treatment of autoimmune inflammation diseases and related disorders.

The cyclic peptide inhibitor(s) of the IL-23R of the present invention is represented by linear form structure of Formula (I'):

R1—X3—X4—X5—X6—X7—X8—X9—X10—X11—X12—X13—X14—X15—X16—X17—R2 (I').

The linear form structure of Formula (I') is intended for exemplary and non-limiting purposes, which will be apparent from examples set forth and exemplified throughout the instant specification, e.g., each such structure may be longer or shorter than the length of fifteen amino acids and/or other corresponding chemical moieties or functional group substituents as defined herein.

Specifically in Formula (I'):

- X3-X17, respectively and individually, represent individual amino acid (aa) residues or other corresponding chemical moieties or functional group substituents as described below and in the instant invention;
- R1 represents the N-terminal end, which may be, for example a hydrogen or a chemical moiety or functional group substituted on the amino group;
- Similarly, R2 represents the carboxyl end, which may be, for example the OH of the carboxyl or a chemical moiety or functional group attached thereto or substituted for the OH group (e.g., an amino group to give a terminal carboxylic acid or amide e.g., —C(O)$HN_2$);
- certain residues as shown in the linear form structures set forth herein may be present or absent, e.g., X3 and/or X17—may be absent;
- The peptide inhibitors have a bond between positions X4 and X9 (e.g., a pair of Pen residues forming a disulfide or an Abu and Cys residue pair forming a thioether) resulting in the formation of a ring structure; and/or
- The bond forming the ring of the structure may, however, be located between other amino acids or chemical moieties besides X4 and X9.

The cyclic IL-23R inhibitors of the present disclosure bear one or more lipid-like substituents (e.g., a lipid or lipid-like group that comprises a hydrophobic moiety), optionally attached by a linker (e.g., a PEG containing linker)).

Lipid-like substituents, referred to herein as "Z" groups, may be attached at various positions of the IL-23 R inhibitors including, but not limited to, R1, X3, X4, X6, X8, X10, X12, X13, X16, X17 and R2, provided the amino acid at the position to be modified has a suitable functional group (e.g., an amine) for lipid attachment. Some suitable amino acids having an amine that can be utilized for lipid attachment include, but are not limited to, K, dK, hK, dhK, Orn, dOrn, Dab, dDab, Dap, and dDap. In addition, lipid-like substituents may be an R1 group and/or an R2 group in any of the IL-23 inhibitors described herein.

Lipids can also be attached to the inhibitor to form branched structures, and a linker e.g., molecule comprised of PEG, may be included between the branch point and the inhibitor. The branch point is generally a diamino carboxylic acid denoted "Xaa". Linker groups with branch points may have the form shown in Z5 provided below.

Such Z groups may have a variety of forms including those set forth as Z1 through Z5 below. Accordingly, each Z present in a molecule may be a Z1, Z2, Z3, Z4 or Z5 that is selected independently. Z1 to Z4 are unbranched and include: Z1 is

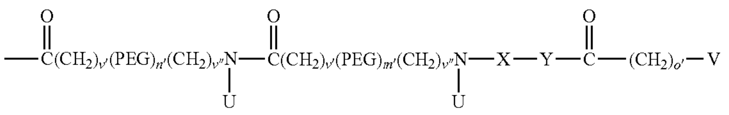

wherein:

- PEG is —$OCH_2CH_2$—;
- n'=0 or 2-24, when n' is 0 the group is absent and replaced by a bond;
- m'=0 or 2-24, when m' is 0 the group is absent and replaced by a bond;
- v' is independently selected from the range of 1-4 for each occurrence;
- v" is independently selected from the range of 0-4 for each occurrence, when v" is 0 the group is replaced by a bond;

x=gE, dgE, 4SB, p, P, ppp, PPP, gE-(c), gE-(C), sp6, gDab, eK, Trx, or absent;

o'=6-18;

Y=gE, sp6, GolA, Pro, D-Pro, meG, Dab, Trx, or absent;

U is hydrogen or methyl;

V=—COOH, tetrazole, GolB, mXOH, pXOH, OPhenyl, carnitine, d-carnitine, or hydrogen. Z2 is

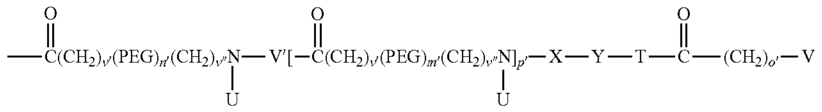

wherein:

PEG is $-OCH_2CH_2-$;

n'=0 or 2-24, when n' is 0 the group is absent and replaced by a bond;

m' is independently selected from 0 or the range of 2-24 for each occurrence, when m' is 0 the group is replaced by a bond;

v' is independently selected from the range of 1-4 for each occurrence;

v" is independently selected from the range of 0-4 for each occurrence, when v" is 0 the group is replaced by a bond;

p' is 1-3;

V' is sp6, gEgE

X=gE, dgE, 4SB, p, P, ppp, PPP, gE-(c), gE-(C), sp6, gDab, eK, Trx, or absent;

Y=gE, sp6, GolA, Pro, D-Pro, meG, Dab, Trx, or absent;

X=Trx;

U is hydrogen or methyl;

o'=6-18;

V=—COOH, tetrazole, GolB, mXOH, pXOH, OPhenyl, carnitine, d-carnitine, or hydrogen;

Z3 is gE-$C(O)(CH_2)_{6-10}CH_3$, or -gE-$C(O)(CH_2)_{11-18}CH_3$;

Z4 is $-C(O)(CH_2)_{6-18}COOH$ or $-C(O)(CH_2)_{6-18}COO$(C1-4 alkyl);

Z5 is branched and is:

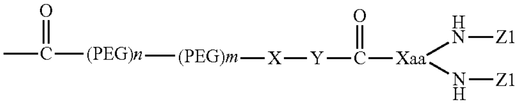

or

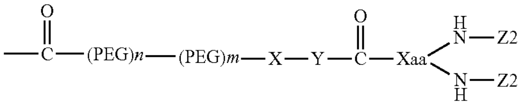

wherein:

n and m are independently selected from the range of 0 to 24;

X is absent or is selected from the group consisting of E, dgE, 4SB, gE-(c), gE-(C), sp6, gDab, eK, or Trx;

Y is absent or is selected from the group consisting of E, dgE, 4SB, gE-(c), gE-(C), sp6, gDab, eK, or Trx;

Xaa is a diamino-carboxylic acid; and

Z1 an Z2 are defined above.

In any of Groups I to X the Z group(s) present in the IL-23 inhibitor compounds may comprise one or more Z1 substituents. In any of Groups I to X the Z group(s) present in the IL-23 inhibitor compounds may comprise one or more Z2 substituents. In any of Groups I to X the Z group(s) present in the IL-23 inhibitor compounds may comprise one or more Z3 substituents.

In any of Groups I to X the Z group(s) present in the IL-23 inhibitor compounds may comprise one or more Z4 substituents. In any of Groups I to X the Z group(s) present in the IL-23 inhibitor compounds may comprise one or more Z5 substituents. In any of Groups I to X the Z group(s) present in the IL-23 inhibitor compounds may comprise one or more substituent selected independently from those set forth in Z1, Z2, X3, or Z4. In any of Groups I to X the Z group(s) present in the IL-23 inhibitor compounds may comprise one or more substituent selected independently from those set forth in Z1, Z2, X3, or Z5. Where more than one Z group is present in a molecule the Z groups may be selected independently.

The present invention invention relates to compounds of Formulas (I'), (I) to (X) pharmaceutically acceptable salts, solvates and/or other forms thereof, corresponding pharmaceutical compositions, methods and/or uses for treatment of autoimmune inflammation diseases and related disorders.

In particular, the present invention relates to peptide inhibitor of the IL-23R or a pharmaceutically acceptable salt(s), solvate(s) and/or other form(s) thereof, corresponding pharmaceutical compositions, methods and/or uses for treatment of disease including autoimmune inflammation diseases and related disorders; where:

the inhibitor of the IL-23R of the present invention is identified by Formulas (I'). (I) to (III); or in Table 1A, Table 1B, Table 1C, Table 1D, Table 1E, Table 1F, Table 1G, Table 1H, Table 11, Table 1J, Table 1K, Table 1L, or Table 1M respectively, in the present specification.

In one aspects, lipidated peptide inhibitors of the IL-23 receptor are linear.

In another aspects, the lipidated peptide inhibitors of the IL-23 receptor are monocyclic.

In other aspects, the lipidated peptide inhibitors of the IL-23 receptor are bicyclic.

The present invention relates to novel lipidated peptide inhibitors of the interleukin-23 receptor (IL-23R) or pharmaceutically acceptable salts, solvates and/or other forms thereof, corresponding pharmaceutical compositions, methods and/or uses of the IL-23R inhibitors for treatment of autoimmune inflammation diseases and/or related disorders.

The present invention relates to compounds which are cyclic inhibitors of an IL-23 receptor comprising an amino acid sequence of Formula (I).

R1—X3—X4—X5—T—X7—X8—X9—X10—X11—THP—X13—N—X15—X16—R2 (I)

wherein:

R1 is hydrogen, $C_1$ to $C_4$ alkyl C(O)—, or $C_1$ to $C_4$ alkyl C(O)— substituted with Cl, F, or cyano, or cPEG3aCO;

X3 is dR, R, K, dK, or absent;

X4 is Pen, Abu, aMeC, or C;

X5 is K—Z or dK-Z;

X7 is 7MeW, W, 3Pya, 7(2ClPh)W, 7(3(1NMepip) pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7 (124TAZP))W, 7(7Imzpy)W, 7BrW, 7EtW, 7PhW, 7PyrW, A, DT, or D7MeW;

X8 is KAc, dK(Ac), K, or dK;

X9 is Pen, Abu, aMeC,or C;

X10 is AEF or dAEF;

X1I is 2-Nal, Phe(2-Me), Phe(3-Me), Phe(4-Me), Phe (3,4-dimethoxy), 2Quin, 3Quin, 1-Nal, unsubstituted Trp, or Trp substituted with cyano, halo, alkyl, haloalkyl, hydroxy, or alkoxy;X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4Triazo-lAla, 4PyridinAla, 4Pya, 3QuinolAla, 30HPhe, 3AmPyrazolAla, 2AmTyr, or 1MeH;

X13 is K(Ac), d(KAc), E, or dE;

X15 is absent, 3pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P, or dP;

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and Z is group comprising a lipid moiety; and wherein the IL-23R inhibitor is cyclized by a disulfide or thioether first bond between X4 and X9.

The present invention also relates to compounds of Formula I, their salts, solvates, or forms thereof, corresponding pharmaceutical compositions, and methods and/or uses for treatment of autoimmune inflammation diseases and related disorders.

The present invention relates to compounds which are bicyclic inhibitors of an IL-23 receptor comprising an amino acid sequence of Formula (X).

R1—R1—X4—N—T—X7—X8—X9—X10—X11—X12—X13—X14—X15—X16—X17—X18—R2 (X)

wherein:

R1 is hydrogen, C1 to C4 alkyl C(O)—, or C1 to C4 alkyl C(O)— substituted with Cl, F, or cyano, 7Ahp, 6Ahx, 5Ava, 6Ava, AEEP, GABA, succinylcarnitine. cPEG3aCO, C1AcPEG4CO, C18gEPEG2PEG2, PEG2PEG2gEC18OH, PentCO, PEG12_OMe, PEG4_OMe, HOC18gEPEG2PEG2, PEG2PEG2gE16OH, C14gEPEG2PEG2CO, C12gEPEG2PEG2CO, PEG4_Decyl, PEG4_Lauryl, PEG4_Capryl, PEG4_Hexyl, PEG2_Palm, PEG2_Myristyl, PEG2_Lauryl, Hexyl, Decyl, PEG2_Decyl, PEG2_Capryl, Oct, HOC16gEPEG2PEG2orn, or C12gEPEG2PEG2CO;

X3 is dR, dK, dK-Z, or absent;

X4 is Pen, aMeC, Abu, or C;

X5 is N, L, Q, K, E, aMeN, dN, dL, dQ, dK, dE, K-Z, or dK-Z;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;X8 is KAc, or Q;

X9 is Pen, C, aMeC, or Abu;

X10 is AEF, F40Me, F(4—CONH2), TMAPF, AEF(G), or F;

X11 is 2-Nal, Phe(2-Me), Phe(3-Me), Phe(4-Me), Phe(3, 4-dimethoxy), 2Quin, 3Quin, 1-Nal, unsubstituted Trp, or Trp substituted with cyano, halo, alkyl, haloalkyl, hydroxy, or alkoxy;

X12 is THP, aMeL, Acvc, or Acpx, or MeK;

X13 is KAc, E, L, dK(Ac), dE, or dL;

X14 is N, K, or K-Z;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, THP, NH(2-(pyridin-3-yl)ethyl), bAla, or aMeF, or 1MeH;

X16 is Sarc, K-Z, NMeK-Z, or absent;

X17 is K-Z, dK-Z, or absent;

R2 is —OH, —NH2, —NH($C_1$ to $C_4$ alkyl), —NH($C_1$-$C_4$ alkyl), or —N($C_1$ to $C_4$ alkyl)$_2$, each alkyl optionally substituted with Cl, F, cyano or Z;

Z is group comprising a lipid moiety; and wherein the IL-23R inhibitor is cyclized by a disulfide or thioether first bond between X4 and X9, and an amide second bond (i) between X5 and X10 when X5 is E and X10 is AEF, or (ii) between X13 and R1 when X13 is E and R1 is 7Ahp, 6Ahx, 5Ava, 6Ava, AEEP, or GABA.

The present invention also relates to compounds of Formula X, their salts, solvates, or forms thereof, corresponding pharmaceutical compositions, and methods and/or uses for treatment of autoimmune inflammation diseases and related disorders.

The present invention relates to compounds which are cyclic inhibitors of an IL-23 receptor comprising an amino acid sequence of Formulas II-IX.

The present invention also relates to compounds of Formula II-IX, their salts, solvates, or forms thereof, corresponding pharmaceutical compositions, and methods and/or uses for treatment of autoimmune inflammation diseases and related disorders The present invention relates to methods or processes of making compound of Formulas (I) to (X) or Tables 1A to 1M.

The present invention also relates to pharmaceutical composition(s), which comprises a herein-described peptide inhibitor compound of the Il-23R or a pharmaceutically acceptable salt, solvate, or form thereof as described herein, and a pharmaceutically acceptable carrier, excipient, or diluent. The pharmaceutical compositions may comprise or may exclude an absorption enhancer depending on the intended route of delivery or use thereof for treatment of specific indications. The absorption enhancer may be permeation enhancer or intestinal permeation enhancer. In an aspect the absorption enhancer improves oral bioavailability.

The present invention relates to method(s) for treating and/or uses(s) for inflammatory disease(s) in a subject, which comprises administering a therapeutically effective amount of one or more herein-described peptide inhibitor compounds of the IL-23R or pharmaceutically acceptable salts, or solvates thereof, or a corresponding pharmaceutical composition as described herein, respectively to a subject in need thereof. Such inflammatory diseases and related disorders may include, but are not limited to, inflammatory bowel disease (IBD), Crohn's disease (CD), ulcerative colitis (UC), psoriasis (PsO), or psoriatic arthritis (PsA) and the like.

The present invention invention provides for the use of one or more herein-described compounds (e.g., compounds of formulas (I) to (X) or Tables 1A to 1M) for the preparation of pharmaceutical compositions for use in the treatment of inflammatory diseases and related disorders including, but not limited to, inflammatory bowel disease (IBD), Crohn's disease (CD), ulcerative colitis (UC), psoriasis (PsO), and psoriatic arthritis (PsA).

The present invention provides for the use of one or more herein-described compounds of formulas (I) to (X) or Tables 1A to 1M in the treatment of inflammatory diseases and related disorders including, but not limited to, inflammatory bowel disease (IBD), Crohn's disease (CD), ulcerative colitis (UC), psoriasis (PsO), and psoriatic arthritis (PsA).

The present provides for kits comprising one or more herein-described compounds of formulas (I) to (X) or Tables 1A to 1L and instructions for use in treating a disease in a patient.

The disease may be an inflammatory diseases or related disorder including, but not limited to, inflammatory bowel disease (IBD), Crohn's disease (CD), ulcerative colitis (UC), psoriasis (PsO), and psoriatic arthritis (PsA)

DETAILED DESCRIPTION

I. General

The present invention relates to novel lipidated peptide inhibitors of the interleukin-23 receptor (IL-23R) or pharmaceutically acceptable salts, solvates and/or other forms thereof, corresponding pharmaceutical compositions, methods and/or uses of the IL-23R inhibitors for treatment of autoimmune inflammation diseases and/or related disorders.

inventionThe present invention inventionto relates to lipidated cyclic peptide inhibitors of an IL-23R. The lipidated cyclic peptide inhibitors of the present invention may exhibit enhanced properties, such as longer in vivo half-life, compared to the corresponding cyclic peptide inhibitor of an IL-23R without a covalently bound lipid (e.g., fatty acid).

II. Definitions

Unless otherwise defined herein, scientific and technical terms used in this application shall have the meanings that are commonly understood by those of ordinary skill in the art.

"About" when referring to a value includes the stated value +/−10% of the stated value. For example, about 50% includes a range of from 45% to 55%, while about 20 molar equivalents includes a range of from 18 to 22 molar equivalents. Accordingly, when referring to a range, "about" refers to each of the stated values +/−10% of the stated value of each end of the range. For instance, a ratio of from about 1 to about 3 (weight/weight) includes a range of from 0.9 to 3.3.

"Patient" or "subject", which are used interchangably, refer to a living organism, which includes, but is not limited to a human subject suffering from or prone to a disease or condition that can be treated by administration of a pharmaceutical composition as provided herein. Further non-limiting examples may include, but is not limited to humans, other mammals, bovines, rats, mice, dogs, monkeys, goat, sheep, cows, deer, horse, and other mammalian animals and the like. In some aspects, the patient is human.

Unless indicated otherwise the names of naturally occurring and non-naturally occurring aminoacyl residues used herein follow the naming conventions suggested by the IUPAC Commission on the Nomenclature of Organic Chemistry and the IUPAC-IUB Commission on Biochemical Nomenclature as set out in "Nomenclature of α-Amino Acids (Recommendations, 1974)" Biochemistry, 14(2), (1975). To the extent that the names and abbreviations of amino acids and aminoacyl residues employed in this specification and appended claims differ from those suggestions, they will be made clear to the reader. In sequences of amino acids that represent IL-23 inhibitors the individual amino acids are separated by a hyphen "-".

Throughout the present specification, unless naturally occurring amino acids are referred to by their full name (e.g., alanine, arginine, etc.), they are designated by their conventional three-letter or single-letter abbreviations (e.g., Ala or A for alanine, Arg or R for arginine, etc.). Unless otherwise indicated, three-letter and single-letter abbreviations of amino acids refer to the L-isomeric form of the amino acid in question. The term "L-amino acid," as used herein, refers to the "L" isomeric form of a peptide, and conversely the term "D-amino acid" refers to the "D" isomeric form of a peptide (e.g., (D)Asp or D-Asp; (D)Phe or D-Phe).

Amino acid residues in the D isomeric form can be substituted for any L-amino acid residue, as long as the desired function is retained by the peptide. D-amino acids may be indicated as customary in lower case when referred to using single-letter abbreviations. For example, L-arginine can be represented as "Arg" or "R," while D-arginine can be represented as "arg" or "r." Similarly, L-lysine can be represented as "Lys" or "K," while D-lysine can be represented as "lys" or "k." Alternatively, a lower case "d" in front of an amino acid can be used to indicate that it is of the D isomeric form, for example D-lysine can be represented by dK. Where "gE" appears in modified aa residues, particularly modified lysine residues (e.g., KPEG2PEG2gEC200H or KPEG6PEG6gEC180H) it denotes isoglutamic acid and any potential conflict can be resolved by reference to the computer readable form of the structure (e.g., Smiles string) associated with most of he structures provided herein.

In the case of less common or non-naturally occurring amino acids, unless they are referred to by their full name (e.g. sarcosine, ornithine, etc.), frequently employed three- or four-character codes are employed for residues thereof, including, Sar or Sarc (sarcosine, i.e. N-methylglycine), Aib (α-aminoisobutyric acid), Dab (2,4-diaminobutanoic acid), Dap (2,3-diaminopropanoic acid), γ-Glu (γ-glutamic acid), Gaba (γ-aminobutanoic acid), β-Pro (pyrrolidine-3-carboxylic acid), and Abu (2-amino butyric acid).

Amino acids of the D-isomeric form may be located at any of the positions in the IL-23R inhibitors set forth herein (any of X1-X18 appearing in the molecule). In an aspects, amino acids of the D-isomeric form may be located only at any one or more of X3, X5, X6, X8, X13, and optionally one additional position. In other aspects, amino acids of the D-isomeric form may be located only at any one or more of X3, X8, X13, and optionally one additional position.

In other aspects, amino acids of the D-isomeric form may be located only at X3, and optionally one additional position. In other aspects, amino acids of the D-isomeric form may be located only at X3, and optionally two or three additional positions. In other aspects, amino acids of the D-isomeric form may be located at only one or two of positions X1 to X18 appearing in the IL-23R inhibitors set forth herein. In other aspects, amino acids of the D-isomeric form may be located at only three or four of positions X1 to X18 appearing in the IL-23R inhibitors set forth herein. For example, an IL-23R inhibitors set forth herein having only positions X3 to X15 present may have amino acids of the D-form present in 3 or four of those positions. In other aspects, amino acids of the D-isomeric form may be located at only five or six of positions X1 to X18 appearing in the IL-23R inhibitors set forth herein.

As conventionally understood in the art or to the skilled artisan, the peptide sequences disclosed herein are shown proceeding from left to right, with the left end of the sequence being the N-terminus of the peptide and the right end of the sequence being the C-terminus of the peptide.

Among sequences disclosed herein are sequences incorporating either an "-OH" moiety or an "—$NH_2$" moiety at the carboxy terminus (C-terminus) of the sequence. In such cases, and unless otherwise indicated, an "-OH" or an "—$NH_2$" moiety at the C-terminus of the sequence indicates a hydroxy group or an amino group, corresponding to the presence of a carboxylic acid (COOH) or an amido ($CONH_2$) group at the C-terminus, respectively. In each sequence of the invention, a C-terminal "-OH" moiety may be substituted for a C-terminal "—$NH_2$" moiety, and vice-versa.

One of skill in the art will appreciate that certain amino acids and other chemical moieties are modified when bound to another molecule. For example, an amino acid side chain may be modified when it forms an intramolecular bridge with another amino acid side chain, e.g., one or more hydrogen may be removed or replaced by the bond.

A "compound of the invention", an "inhibitor of the present invention", an "IL-23R inhibitor of the present invention", a "compound described herein", and a "herein-described compound" include the novel compounds disclosed herein, for example the compounds of any of the Examples, including compounds of Formula (I) to (X) such as those found in Table 1A, Table 1B, Table 1C, Table 1D, Table 1E, Table 1F, Table 1G Table 1H, Table 11, Table 1J, Table 1K, Table 1L or Table 1M.

"Pharmaceutically effective amount" refers to an amount of a compound of the invention in a composition or combination thereof that provides the desired therapeutic or pharmaceutical result.

By "pharmaceutically acceptable" it is meant the carrier (s), diluent(s), salts, or excipient(s) must be compatible with the other components or ingredients of the compositions of the present invention, i.e., that which is useful, safe, non-toxic acceptable for pharmaceutical use. In accordance with the present invention pharmaceutically acceptable means approved or approvable as is listed in the U.S. Pharmacopoeia or other generally recognized pharmacopoeia for use in animals, and more particularly, in humans.

"Pharmaceutically acceptable excipient" includes without limitation any adjuvant, carrier, excipient, glidant, sweetening agent, diluent, preservative, dye/colorant, flavor enhancer, surfactant, wetting agent, dispersing agent, suspending agent, stabilizer, isotonic agent, solvent, or emulsifier which has been approved by the United States Food and Drug Administration as being acceptable for use in humans or domestic animals.

"Absorption enhancer" refers to a component that improves or facilitates the mucosal absorption of a drug in the gastrointestinal tract, such as a permeation enhancer or intestinal permeation enhancer. As conventionally understood in the art, permeation enhancers (PEs) are agents aimed to improve oral delivery of therapeutic drugs with poor bioavailability. PEs are capable of increasing the paracellular and/or transcellular passage of drugs.

Pharmaceutical excipients that can increase permeation have been termed "absorption modifying excipients" (AMEs). AMEs may be used in oral compositions, for example, as wetting agents (sodium dodecyl sulfate), antioxidants (e.g., EDTA), and emulsifiers (e.g., macrogol glycerides), and may be specifically included in compositions as PEs to improve bioavailability. PEs can be categorized as to how they alter barrier integrity via paracellular or transcellular routes.

"Intestinal permeation enhancer (IPE)" refers to a component that improves the bioavailability of a component. Suitable representative IPEs for use in the present invention, include, but are not limited to, various surfactants, fatty acids, medium chain glycerides, steroidal detergents, acyl carnitine and alkanoylcholines, N-acetylated alpha-amino acids and N-acetylated non-alpha-amino acids, and chitosans, other mucoadhesive polymers and the like. For example, a suitable IPE for use in the present invention may be sodium caprate.

"Composition" or "Pharmaceutical Composition" as used herein is intended to encompass an invention or product comprising the specified active product ingredient (API), which may include pharmaceutically acceptable excipients, carriers or diluents as described herein, such as in specified amounts defined throughout the invention. Compositions or Pharmaceutical Compositions result from combination of specific components, such as specified ingredients in the specified amounts as described herein.

Compositions or pharmaceutical compositions of the present invention may be in different pharmaceutically acceptable forms, which may include, but are not limited to a liquid composition, a tablet or matrix composition, a capsule composition, etc. and the like. When the composition is a tablet composition, the tablet may include, but is not limited to different layers two or more different phases, including an internal phase and an external phase that can comprise a core. The tablet composition can also include but is not limited to one or more coatings.

"Solvate" as used herein, means a physical association of the compound of the present invention with one or more solvent molecules. This physical association involves varying degrees bonding, including hydrogen bonding. In certain instances, the solvate will be capable of isolation. The term "solvate" is intended to encompass both solution-phase and isolatable solvates. Non-limiting examples of suitable solvates include hydrates.

Provided are also pharmaceutically acceptable salts and tautomeric forms of the compounds described herein. "Pharmaceutically acceptable" or "physiologically acceptable" refer to compounds, salts, compositions, dosage forms and other materials which are useful in preparing a pharmaceutical composition that is suitable for veterinary or human pharmaceutical use.

The IL-23R inhibitors of the present invention, or their pharmaceutically acceptable salts or solvates may contain one or more asymmetric centers and may thus give rise to enantiomers, diastereomers, and other stereoisomeric forms that may be defined, in terms of absolute stereochemistry, as (R)- or (S)- or, as (D)- or (L)-for amino acids. The present invention is meant to include all such possible isomers, as well as their racemic and optically pure forms of the IL-23R inhibitors of the present invention. Optically active (+) and (−), (R)- and (S)-, or (D)- and (L)-isomers may be prepared using chiral synthons or chiral reagents, or resolved using conventional techniques, for example, chromatography and fractional crystallization. Conventional techniques for the preparation/isolation of individual enantiomers include chiral synthesis from a suitable optically pure precursor or resolution of the racemate (or the racemate of a salt or derivative) using, for example, chiral high pressure liquid chromatography (HPLC). When the compounds described herein contain olefinic double bonds or other centers of geometric asymmetry, and unless specified otherwise, it is intended that the compounds include both E and Z geometric isomers. Likewise, all tautomeric forms are also intended to be included. Where compounds are represented in their chiral form, it is understood that the aspect encompasses, but is not limited to, the specific diastereomerically or enantiomerically enriched form. Where chirality is not specified but is present, it is understood that the aspect is directed to either the specific diastereomerically or enantiomerically enriched form; or a racemic or scalemic mixture of such compound(s). As used herein, "scalemic mixture" is a mixture of stereoisomers enaintiomers at a ratio other than 1:1.

"Racemates" refers to a mixture of enantiomers. The mixture can include equal or unequal amounts of each enantiomer.

"Stereoisomer" and "stereoisomers" refer to compounds that differ in the chirality of one or more stereocenters. Stereoisomers include enantiomers and diastereomers. The compounds may exist in stereoisomeric form if they possess one or more asymmetric centers or a double bond with asymmetric substitution and, therefore, can be produced as individual stereoisomers or as mixtures. Unless otherwise indicated, the description is intended to include individual stereoisomers as well as mixtures. The methods for the determination of stereochemistry and the separation of stereoisomers are well-known in the art (see, e.g., Chapter 4 of Advanced Organic Chemistry, 4th ed., J. March, John Wiley and Sons, New York, 1992).

"Tautomer" refers to alternate forms of a compound that differ in the position of a proton, such as enol-keto and imine-enamine tautomers, or the tautomeric forms of heteroaryl groups containing a ring atom attached to both a ring —NH— and a ring =N— such as pyrazoles, imidazoles, benzimidazoles, triazoles, and tetrazoles.

Unless defined otherwise, all technical and scientific terms used herein have the same meaning as commonly or conventionally understood by one of ordinary skill in the art. In the Chemical Arts.a dash at the front or end of a chemical group is a matter of convenience; chemical groups may be depicted with or without one or more dashes without losing their ordinary meaning. A wavy line drawn through a line in a structure indicates a point of attachment of a group. A dashed line indicates an optional bond. Unless chemically or structurally required, no directionality is indicated or implied by the order in which a chemical group is written or the point at which it is attached to the remainder of the molecule. For instance, the group "$—SO_2CH_2$-" is equivalent to "$—CH_2SO_2—$" and both may be connected in either direction. Similarly, an "arylalkyl" group, for example, may be attached to the remainder of the molecule at either an aryl or an alkyl portion of the group. A prefix such as "Cu-," or ($C_u$-$C_v$) indicates that the following group has from u to v carbon atoms. For example, "$C_{1-6}$alkyl" and "$C_1$-$C_6$ alkyl" both indicate that the alkyl group has from 1 to 6 carbon atoms.

"Fatty acid" as used herein is an unbranched alkanoic acid of at least six carbons, for example, 7, 8, 9, 10, 11, 12, 13, 14, 15, 16, 17, 18, 19, 20, 21, 22, or more carbons, in length. The fatty acid can contain 1, 2, 3, or more carboxylic acid groups. The fatty acid can include other functional groups, such as but not limited to, amides and phenyl rings. Exemplary fatty acids include hexanoic acid, octanoic acid, decanoic acid, dodecanoic acid, tetradecanoic acid, hexadecanoic acid, octadecanoic acid, 1,6-hexanedioic acid, 1,8-octanedioic acid, 1,10-decanedioic acid, 1,12-dodecanedioic acid, 1,14-tetradecanedioic acid, 1,16-hexadecanedioic acid, and 1,18-octadecanedioic acid.

"Lipidation" refers to a process of covalently attaching one or more fatty acids directly or indirectly to a cyclic peptide inhibitor of an interleukin-23 receptor described herein. A cyclic peptide inhibitor of an interleukin-23 receptor that has undergone lipidation is said to be lipidated. The process of covalent attachment can convert the carboxylic acid into another functional group, such as a secondary amide, or can occur at another functional group present on the fatty acid in order to retain the carboxylic acid present in the original fatty acid. The covalent attachment of the one or more fatty acids can be directly attached to a compound, or indirectly attached through a divalent linker moiety between the one or more fatty acids and the cyclic peptide inhibitor of an interleukin-23 receptor. A divalent linker moiety can include one or more amino acids, a polyethylene glycol (PEG), or a combination thereof. A linker moiety containing a PEG can further exhibit other functional groups, such as an amide, as needed for covalent attachment. Linker moieties comprising one or more amino acids can be attached via the C-terminus, the N-terminus, the side chain, or any combination thereof.

"Polyethylene glycol" or "PEG" is a polyether monovalent radical of general formula $—(O—CH_2—CH_2)_n—OH$, or divalent radical of formula $—(O—CH_2—CH_2)_n—O—$, wherein n is an integer greater than 1. When followed by a number, the PEG indicates the number of repeated units in the moiety. For instance, PEG3 can correspond with a divalent radical of formula $—(O—CH_2—CH_2)_3—O—$, while PEG8 can correspond with a monovalent radical of formula $—(O—CH_2—CH_2)_8—OH$.

PEGs are prepared by polymerization of ethylene oxide and are commercially available over a range of molecular weights from 300 Da to 10,000,000 Da. Lower molecular weight PEGs are generally available as pure oligomers, referred to as monodisperse, uniform, or discrete. These are used in certain aspects of the present invention. In certain aspects, the PEG is PEG2, PEG3, PEG4, PEG5, PEG6, PEG7, PEG8, PEG9, PEG10, PEG11, PEG12, PEG18, or PEG24. In certain aspects, the PEG is PEG2, PEG6, or PEG24.

"Treatment" or "treat" or "treating" as used herein refers to an approach for obtaining beneficial or desired results. For purposes of the present invention, beneficial or desired results include, but are not limited to, alleviation of a symptom and/or diminishment of the extent of a symptom and/or preventing a worsening of a symptom associated with a disease or condition. In one aspect, "treatment" or "treating" includes one or more of the following: (a) inhibiting the disease or condition (e.g., decreasing one or more symptoms resulting from the disease or condition, and/or diminishing the extent of the disease or condition); (b) slowing or arresting the development of one or more symptoms associated with the disease or condition (e.g., stabilizing the disease or condition, delaying the worsening or progression of the disease or condition); and (c) relieving the disease or condition, e.g., causing the regression of clinical symptoms, ameliorating the disease state, delaying the progression of the disease, increasing the quality of life, and/or prolonging survival.

"Therapeutically effective amount" or "effective amount" as used herein refers to an amount that is effective to elicit the desired biological or medical response, including the amount of a compound that, when administered to a subject for treating a disease, is sufficient to affect such treatment for the disease. The effective amount will vary depending on the compound, the disease, and its severity and the age, weight, etc., of the subject to be treated. The effective amount can include a range of amounts. As is understood in the art, an effective amount may be in one or more doses, i.e., a single dose or multiple doses may be required to achieve the desired treatment endpoint. An effective amount may be considered in the context of administering one or more therapeutic agents, and a single agent may be considered to be given in an effective amount if, in conjunction with one or more other agents, a desirable or beneficial result may be or is achieved. Suitable doses of any co-administered compounds may optionally be lowered due to the combined action (e.g., additive or synergistic effects) of the compounds.

"Co-administration" as used herein refers to administration of unit dosages of the compounds disclosed herein before or after administration of unit dosages of one or more additional therapeutic agents, for example, administration of the compound disclosed herein within seconds, minutes, or hours of the administration of one or more additional therapeutic agents. For example, in some respects, a unit dose of a compound of the invention is administered first, followed within seconds or minutes by administration of a unit dose of one or more additional therapeutic agents. Alternatively, in other aspects, a unit dose of one or more additional therapeutic agents is administered first, followed by administration of a unit dose of a compound of the invention within seconds or minutes. In some respects, a unit dose of a compound of the invention is administered first, followed, after a period of hours (e.g., 1-12 hours), by administration of a unit dose of one or more additional therapeutic agents. In other aspects, a unit dose of one or more additional therapeutic agents is administered first, followed, after a period of hours (e.g., 1-12 hours), by administration of a unit dose of a compound of the invention. Co-administration of a compound disclosed herein with one or more additional therapeutic agents generally refers to simultaneous or sequential administration of a compound disclosed herein and one or more additional therapeutic agents, such that therapeutically effective amounts of each agent are present in the body of the patient.

Abbreviation, "(V/V)" refers to the phrase "volume for volume", i.e., the proportion of a particular substance within a mixture, as measured by volume or a volume amount of a component of the composition disclosed herein relative to the total volume amount of the composition. Accordingly, the quantity is unit less and represents a volume percentage amount of a component relative to the total volume of the composition. For example, a 2% (V/V) solvent mixture can indicate 2 mL of one solvent is present in 100 mL of the solvent mixture.

Abbreviation, "(w/w)" refers to the phrase "weight for weight", i.e., the proportion of a particular substance within a mixture, as measured by weight or mass or a weight amount of a component of the composition disclosed herein relative to the total weight amount of the composition. Accordingly, the quantity is unit less and represents a weight percentage amount of a component relative to the total weight of the composition. For example, a 2% (w/w) solution can indicate 2 grams of solute is dissolved in 100 grams of solution.

Systemic routes of administration as conventionally understood in the medicinal or pharmaceutical arts, refer to or are defined as a route of administration of drug, a pharmaceutical composition or formulation, or other substance into the circulatory system so that various body tissues and organs are exposed to the drug, formulation or other substance. As conventionally understood in the art, administration can take place orally (where drug or oral preparations are taken by mouth, and absorbed via the gastrointestinal tract), via enteral administration (absorption of the drug also occurs through the gastrointestinal tract) or parenteral administration (generally injection, infusion, or implantation, etc.

"Systemically active" peptide drug therapy as it relates to the present invention generally refers to treatment by means of a pharmaceutical composition comprising a peptide active ingredient, wherein said peptide resists immediate metabolism and/or excretion resulting in its exposure in various body tissues and organs, such as the cardiovascular, respiratory, gastrointestinal, nervous or immune systems.

Systemic drug activity in the present invention also refers to treatment using substances that travel through the bloodstream, reaching and affecting cells in various body tissues and organs. Systemic active drugs are transported to their site of action and work throughout the body to attack the physiological processes that cause inflammatory diseases.

"Bioavailability" refers to the extent and rate at which the active moiety (drug or metabolite) enters systemic circulation, thereby accessing the site of action. Bioavailability of a drug is impacted by the properties of the dosage form, which depend partly on its design and manufacture.

"Digestive tract tissue" as used herein refers to all the tissues that comprise the organs of the alimentary canal. For example, only, and without limitation, "digestive tract tissue" includes tissues of the mouth, esophagus, stomach, small intestine, large intestine, duodenum, and anus.

III. Compounds

The present invention relates to novel lipidated cyclic peptide inhibitors of the interleukin-23 receptor (IL-23R) or pharmaceutically acceptable salt thereof.

In particular, the present invention relates to a lipidated cyclic peptide inhibitor compound of the interleukin-23 receptor (IL-23R) or a pharmaceutically acceptable salt thereof, where each compound structure is as identified in Table 1A, Table 1B, Table 1C, Table 1D, Table 1E, Table 1F, Table 1G, Table 1H, Table 11, Table 1J, Table 1K, or Table 1L of the present specification.

In one aspect, a lipidated cyclic peptide inhibitor compound of the interleukin-23 receptor (IL-23R) compound, or a pharmaceutically acceptable salt thereof, has a structure of a compound in Table 1A.

In another aspect, a lipidated cyclic peptide inhibitor compound of the interleukin-23 receptor (IL-23R) compound or a pharmaceutically acceptable salt thereof, has a structure of a compound in Table 1B.

In another aspect, a lipidated cyclic peptide inhibitor compound of the interleukin-23 receptor (IL-23R) compound or a pharmaceutically acceptable salt thereof, has a structure of a compound in Table 1C.

In another aspect, a lipidated cyclic peptide inhibitor compound of the interleukin-23 receptor (IL-23R) compound or a pharmaceutically acceptable salt thereof, has a structure of a compound in Table 1D.

In another aspect, a lipidated cyclic peptide inhibitor compound of the interleukin-23 receptor (IL-23R) compound or a pharmaceutically acceptable salt thereof, has a structure of a compound in Table 1E.

In another aspect, a lipidated cyclic peptide inhibitor compound of the interleukin-23 receptor (IL-23R) compound or a pharmaceutically acceptable salt thereof, has a structure of a compound in Table 1F.

In another aspect, a lipidated cyclic peptide inhibitor compound of the interleukin-23 receptor (IL-23R) compound or a pharmaceutically acceptable salt thereof, has a structure of a compound in Table 1G.

In another aspect, a lipidated cyclic peptide inhibitor compound of the interleukin-23 receptor (IL-23R) compound or a pharmaceutically acceptable salt thereof, has a structure of a compound in Table 1H.

In another aspect, a lipidated cyclic peptide inhibitor compound of the interleukin-23 receptor (IL-23R) compound or a pharmaceutically acceptable salt thereof, has a structure of a compound in Table 1I.

In another aspect, a lipidated cyclic peptide inhibitor compound of the interleukin-23 receptor (IL-23R) compound or a pharmaceutically acceptable salt thereof, has a structure of a compound in Table 1J.

In another aspect, a lipidated cyclic peptide inhibitor compound of the interleukin-23 receptor (IL-23R) compound or a pharmaceutically acceptable salt thereof, has a structure of a compound in Table 1K.

In another aspect, a lipidated cyclic peptide inhibitor compound of the interleukin-23 receptor (IL-23R) compound or a pharmaceutically acceptable salt thereof, has a structure of a compound in Table 1L.

In another aspect, a lipidated cyclic peptide inhibitor compound of the interleukin-23 receptor (IL-23R) compound or a pharmaceutically acceptable salt thereof, has a structure of a compound in Table 1M.

TABLE 1A

| Compounds | |
|---|---|
| SEQ Id | Structure: |
| 2 | 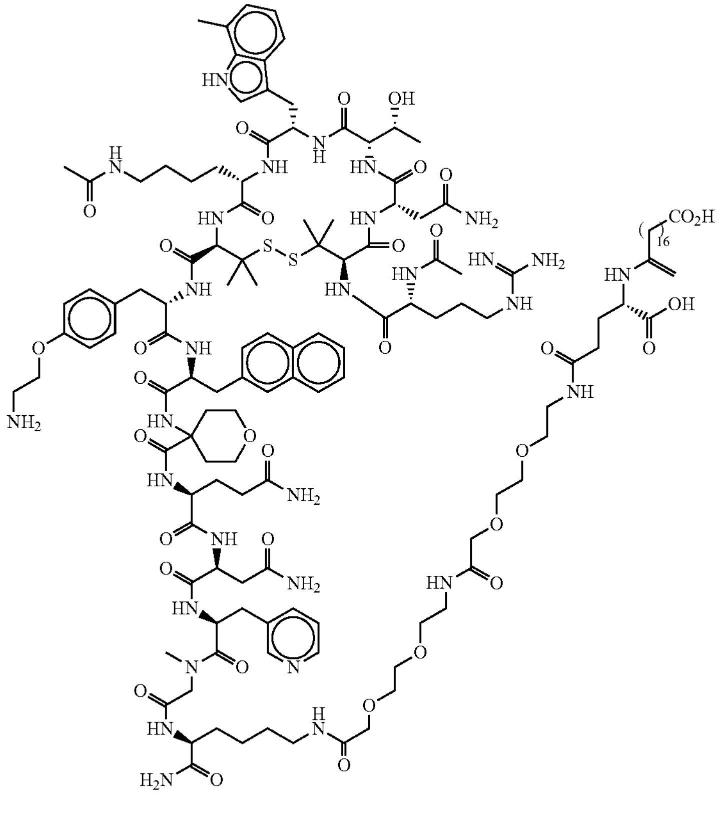 (Example 2) MeCO-r-Pen*-N-T-7MeW-K(Ac)-Pen*-AEF-2Nal-THP-E-N-3Pya-Sar-K(PEG2PEG2gEC18OH)-CONH2 |

TABLE 1A-continued
| Compounds | |
|---|---|
| SEQ Id | Structure: |
| 3 | 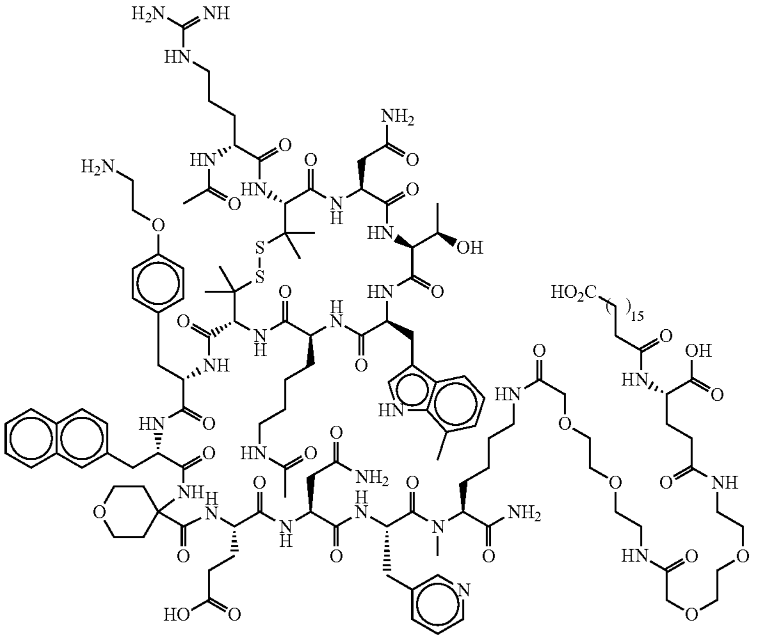<br>(Example 3) MeCO-r-Pen*-N-T-7MeW-K(Ac)-Pen*-AEF-2Nal-THP-E-N-3Pya-Sar-K(PEG2PEG2gEC18OH)-CONH2 |
| 4 | 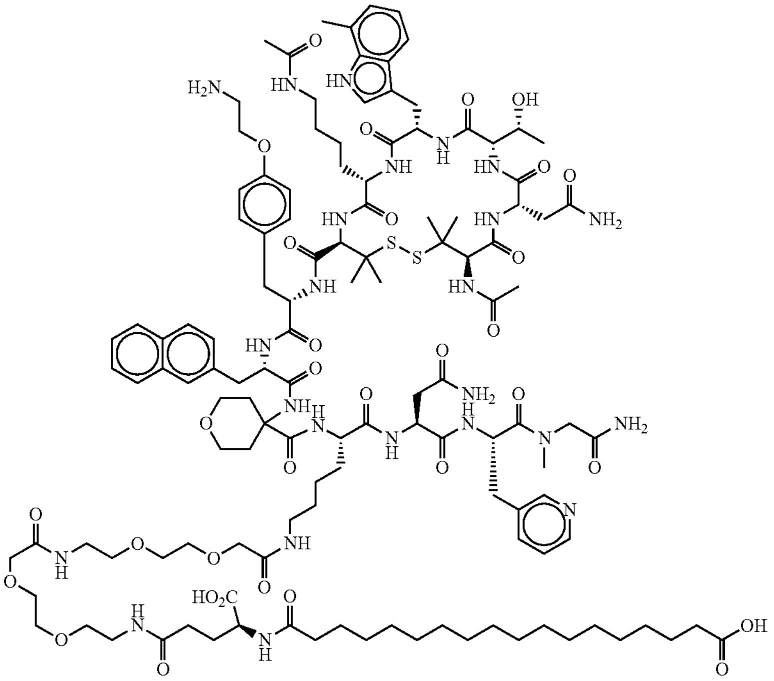<br>(Example 4) MeCO-Pen*-N-T-7MeW-K(Ac)-Pen*-AEF-2Nal-THP-K(PEG2PEG2gEC18OH)-N-3Pya-Sar-CONH2 |

TABLE 1A-continued
| Compounds | |
|---|---|
| SEQ Id | Structure: |
| 5 | 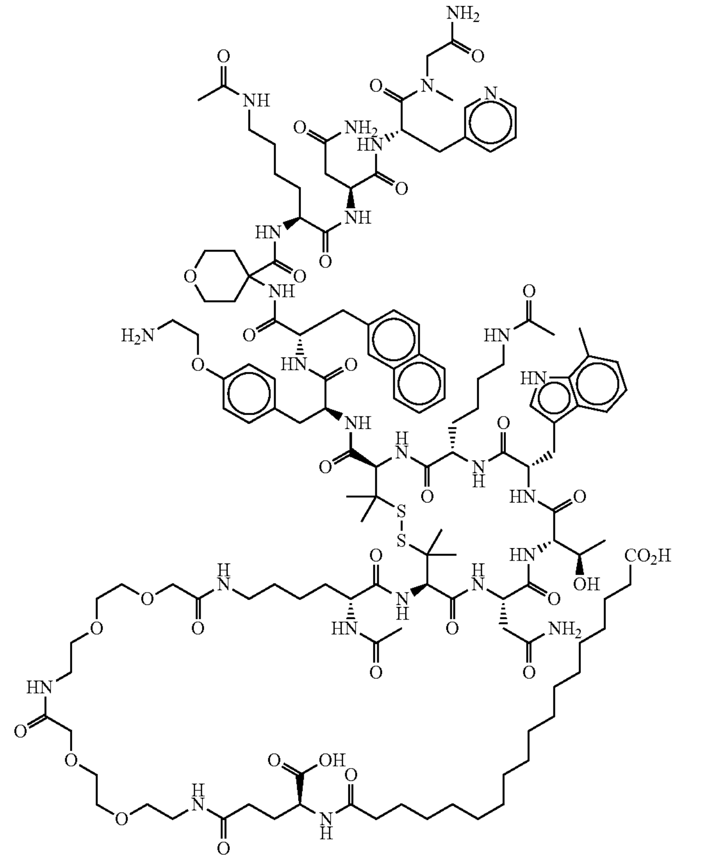<br>(Example 5) MeCO-k(PEG2PEG2gEC18OH)-Pen*-N-T-7MeW-K(Ac)-Pen*-AEF-2Nal-THP-K(Ac)-N-3Pya-Sar-CONH2 |

TABLE 1A-continued
| Compounds | |
|---|---|
| SEQ Id | Structure: |
| 6 | 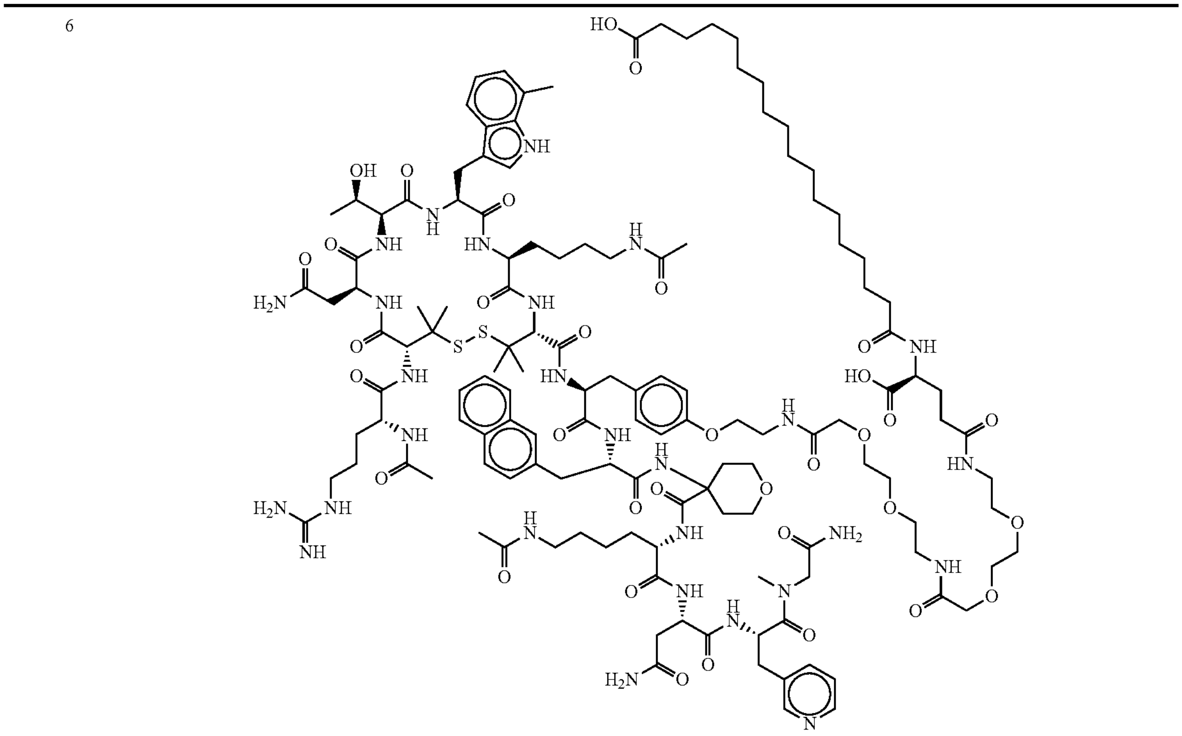<br>(Example 6) MeCO-r-Pen*-N-T-7MeW-K(Ac)-Pen*-AEF(PEG2PEG2gEC18OH)-2Nal-THP-K(Ac)-N-3Pya-Sar-CONH2 |
| 7 | 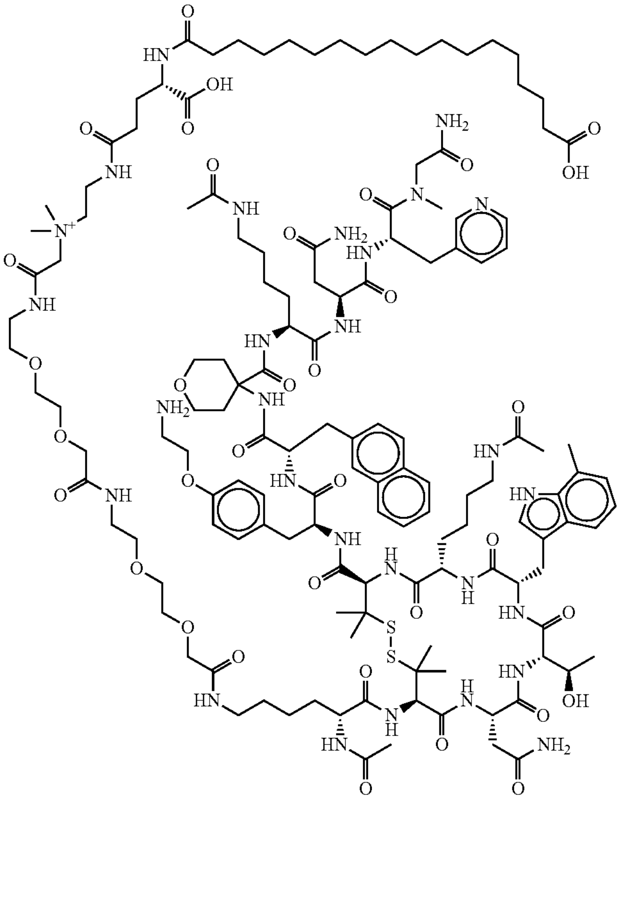 |

TABLE 1A-continued
| Compounds | |
|---|---|
| SEQ Id | Structure: |
| | (Example 7) MeCO-r-Pen*-N-T-7MeW-K(Ac)-Pen*-AEF(PEG2PEG2gEC18OH)-2Nal-THP-K(Ac)-N-3Pya-Sar-CONH2 |
| 8 | 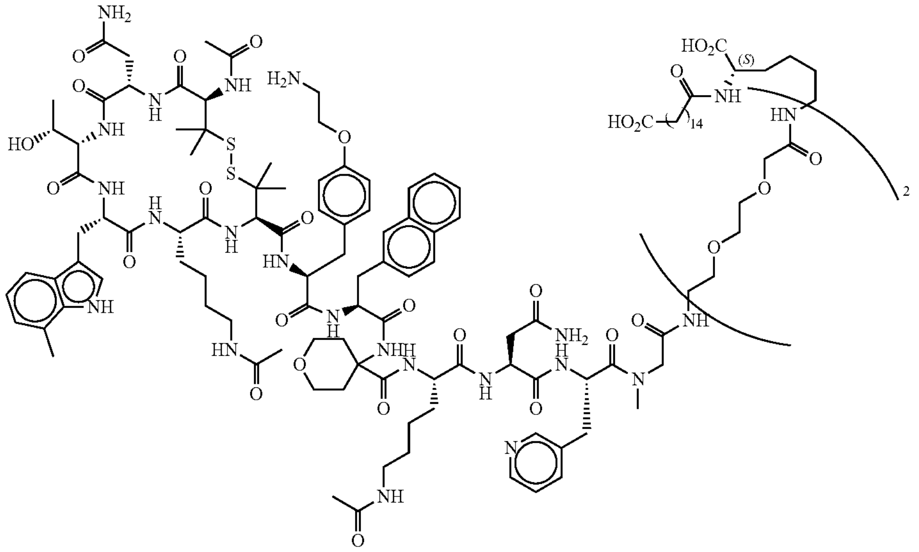 |
| | (Example 8) MeCO-Pen*-N-T-7MeW-K(Ac)-Pen*-AEF-2Nal-THP-K(Ac)-N-3Pya-Sar-PEG2-PEG2-eK(C16OH)-COOH |

TABLE 1A-continued
| Compounds | |
|---|---|
| SEQ Id | Structure: |
| 9 | 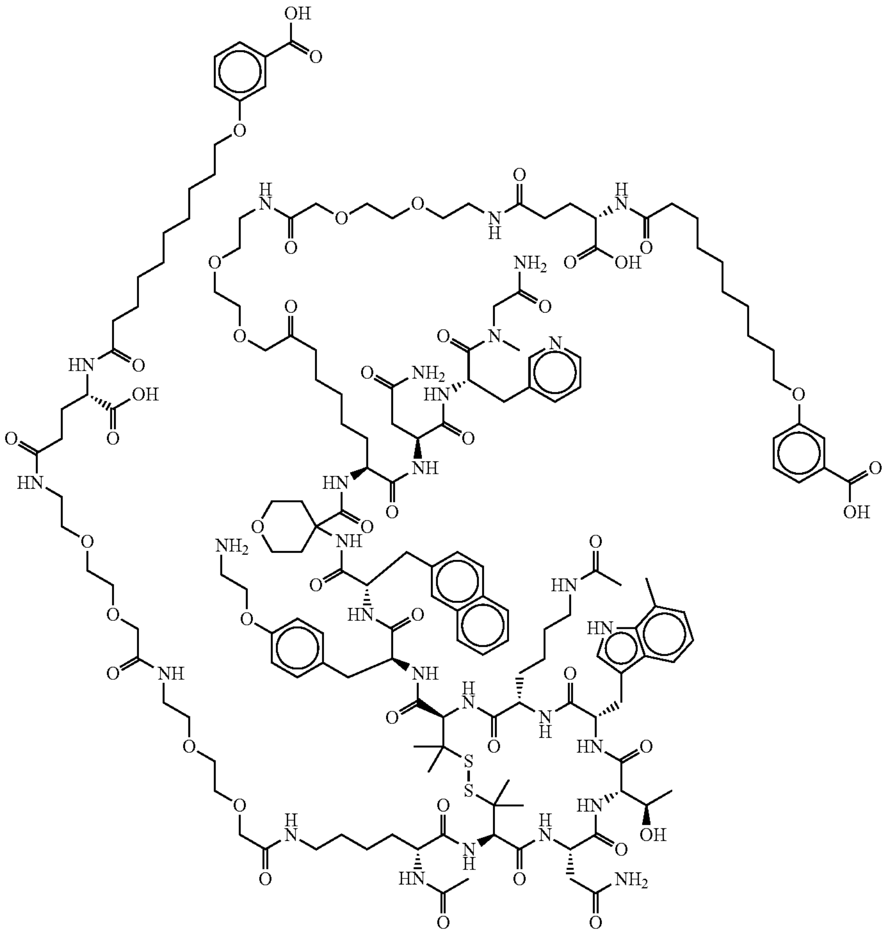<br>(Example 9) MeCO-k(PEG2PEG2gEmXOH)-Pen*-N-T-7MeW-K(Ac)-Pen*-AEF-2Nal-THP-K(PEG2PEG2gEmXOH)-N-3Pya-Sar-CONH2 |

TABLE 1A-continued
| Compounds | |
|---|---|
| SEQ Id | Structure: |
| 10 | 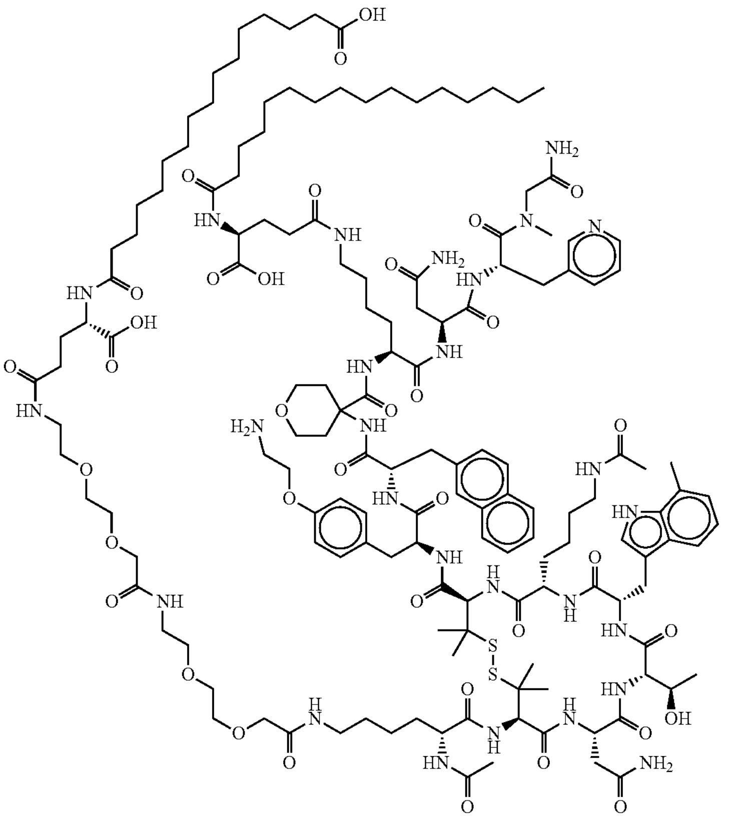<br>(Example 10) MeCO-k(PEG2PEG2gEC16OH)-Pen*-N-T-7MeW-K(Ac)-Pen*-AEF-2Nal-THP-K(gEC16)-N-3Pya-Sar-CONH2 |
| 11 | 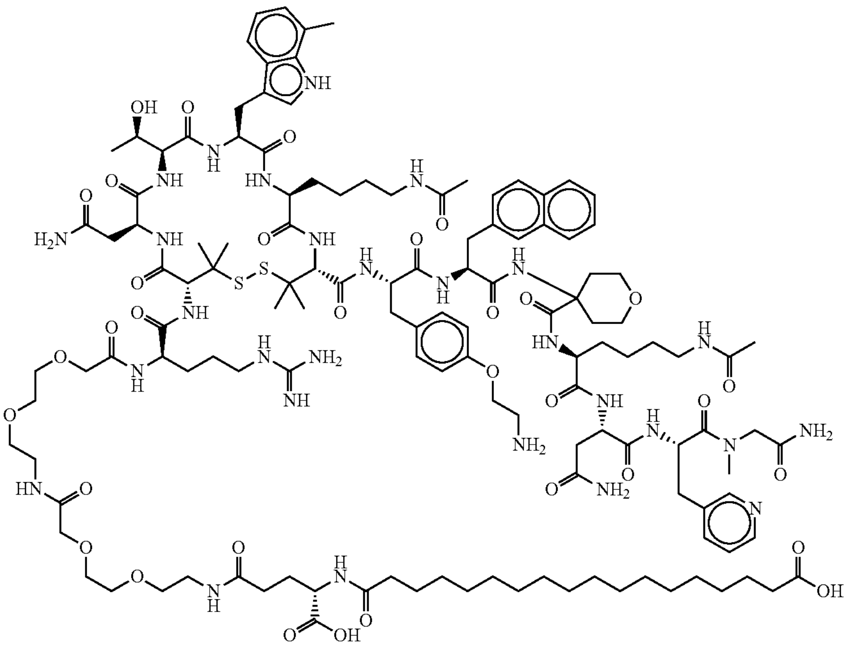 |

TABLE 1A-continued
| Compounds | |
|---|---|
| SEQ Id | Structure: |
| | (Example 11) MeCO-k(PEG2PEG2gEC16OH)-Pen*-N-T-7MeW-K(Ac)-Pen*-AEF-2Nal-THP-K(gEC16)-N-3Pya-Sar-CONH2 |
| 12 | 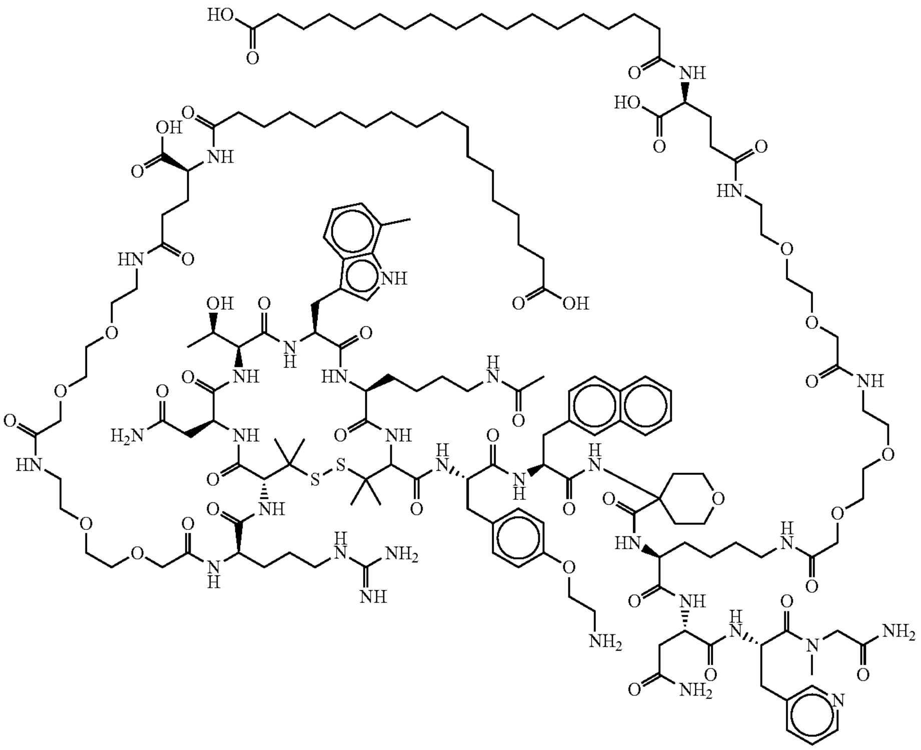 |
| | (Example 12) MeCO-k(PEG2PEG2gEC16OH)-Pen*-N-T-7MeW-K(Ac)-Pen*-AEF-2Nal-THP-K(gEC16)-N-3Pya-Sar-CONH2 |
| 13 | 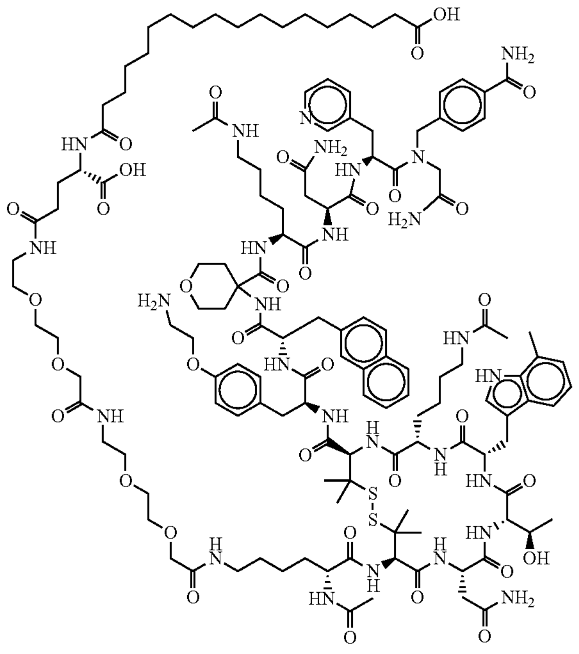 |

TABLE 1A-continued
| Compounds | |
|---|---|
| SEQ Id | Structure: |
| | (Example 13) MeCO-k(PEG2PEG2gEC16OH)-Pen*-N-T-7MeW-K(Ac)-Pen*-AEF-2Nal-THP-K(gEC16)-N-3Pya-Sar-CONH2 |
| 14 | 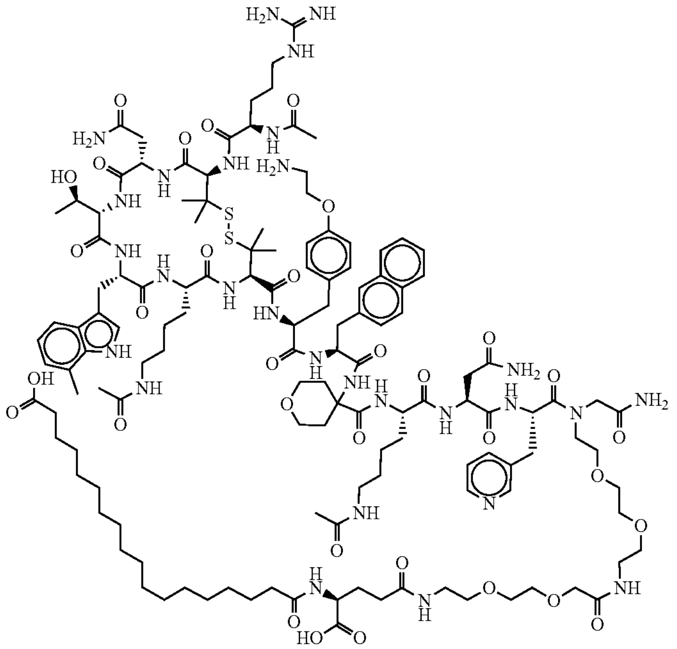 |
| | (Example 14) MeCO-r-Pen*-N-T-7MeW-K(Ac)-Pen*-AEF-2Nal-THP-K(Ac)-N-3Pya-N(PEG2PEG2gEC18OH)Gly-CONH2 |

TABLE 1A-continued
| Compounds | |
|---|---|
| SEQ Id | Structure: |
| 15 | 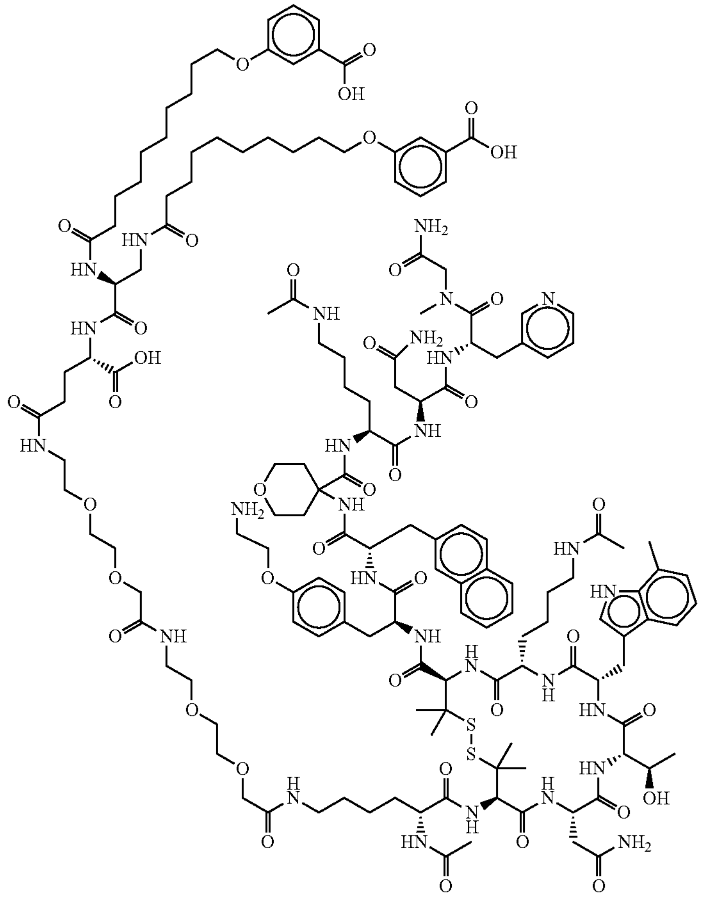<br>(Example 15) MeCO-r-Pen*-N-T-7MeW-K(Ac)-Pen*-AEF-2Nal-THP-K(Ac)-N-3Pya-N(PEG2PEG2gEC18OH)Gly-CONH2 |

TABLE 1A-continued
| SEQ Id | Compounds<br>Structure: |
| --- | --- |
| 16 | 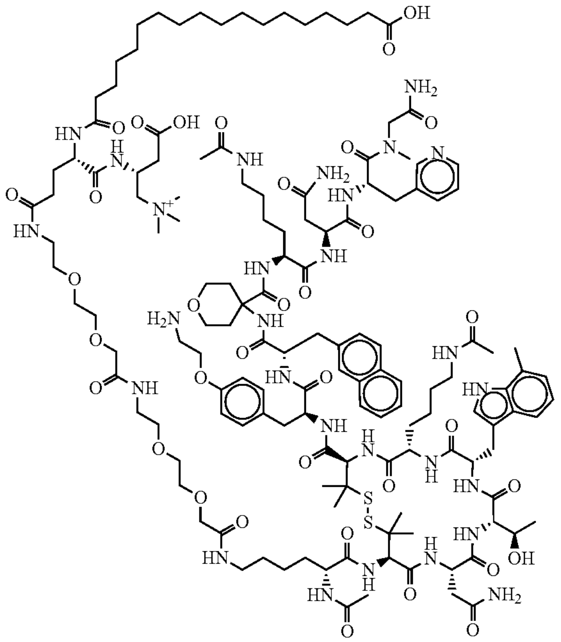<br>(Example 16) MeCO-k(PEG2PEG2gE(c)C18OH)-Pen*-N-T-7MeW-K(Ac)-Pen*-AEF-2Nal-THP-K(Ac)-N-3Pya-Sar-CONH2 |
| 17 | 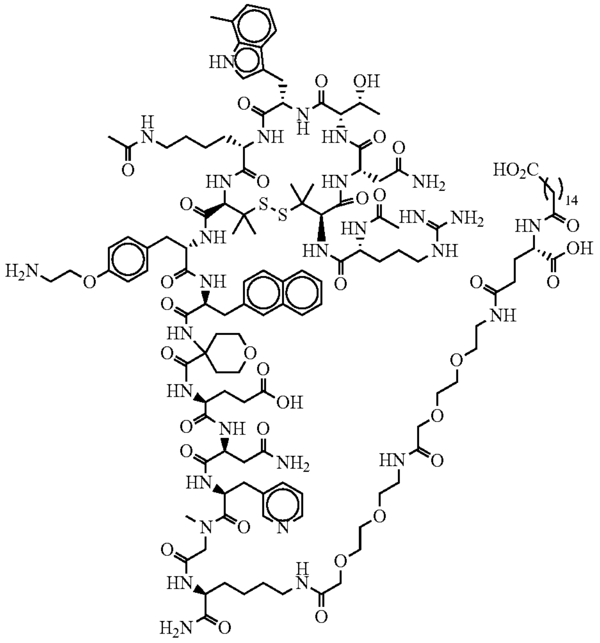<br>(Example 17) |

TABLE 1A-continued
| Compounds | |
|---|---|
| SEQ Id | Structure: |
| 18 | 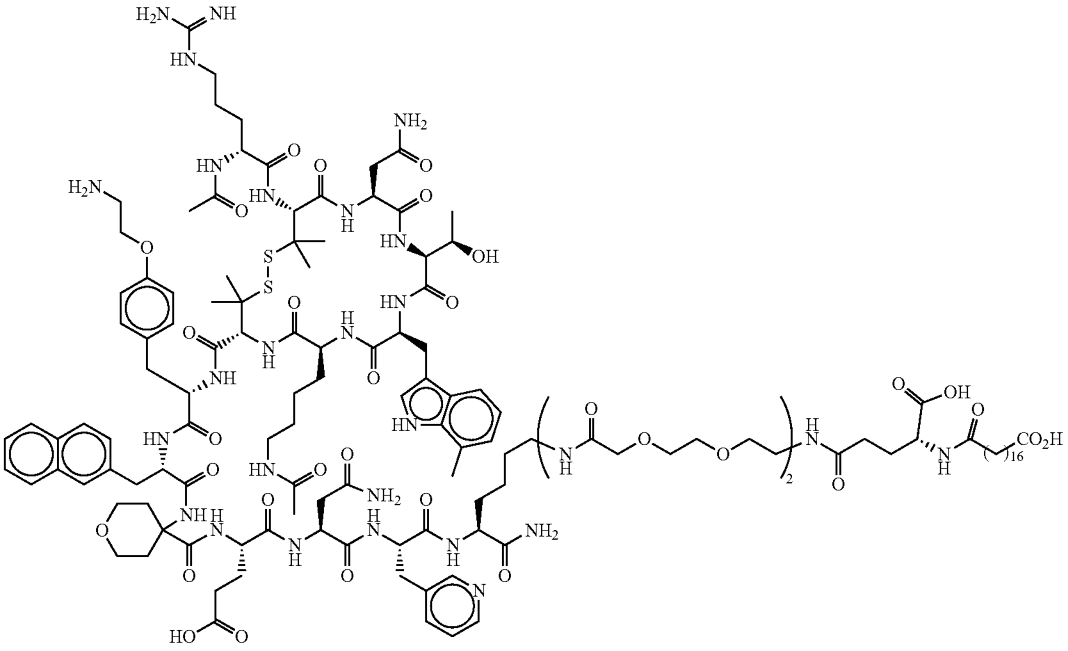<br>(Example 18) |
| 19 | 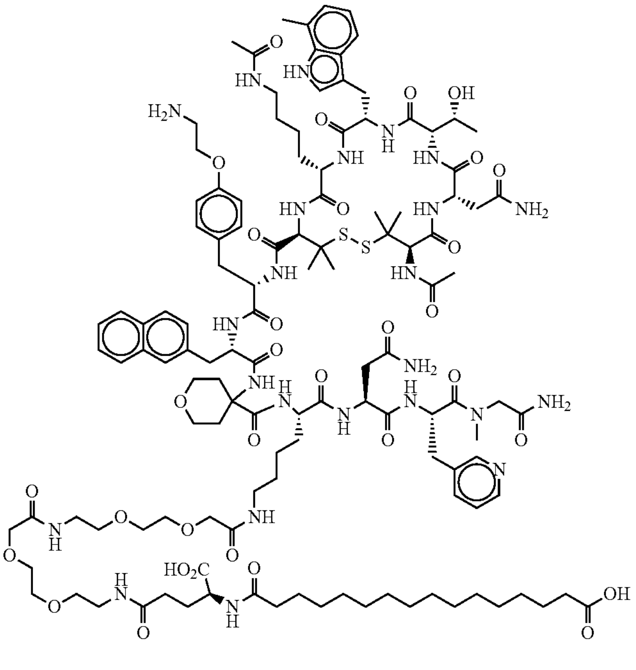<br>(Example 19) |

TABLE 1A-continued
| Compounds | |
|---|---|
| SEQ Id | Structure: |
| 20 | 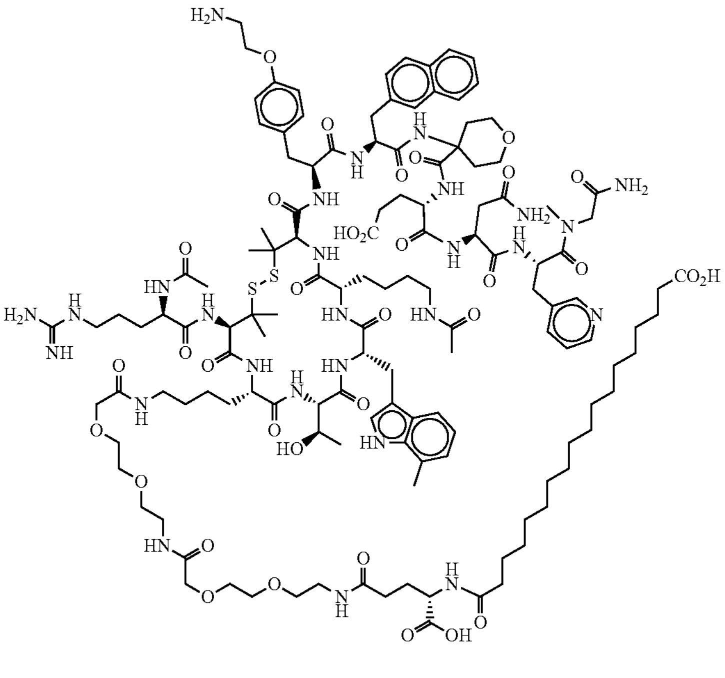 (Example 20) |
| 21 | 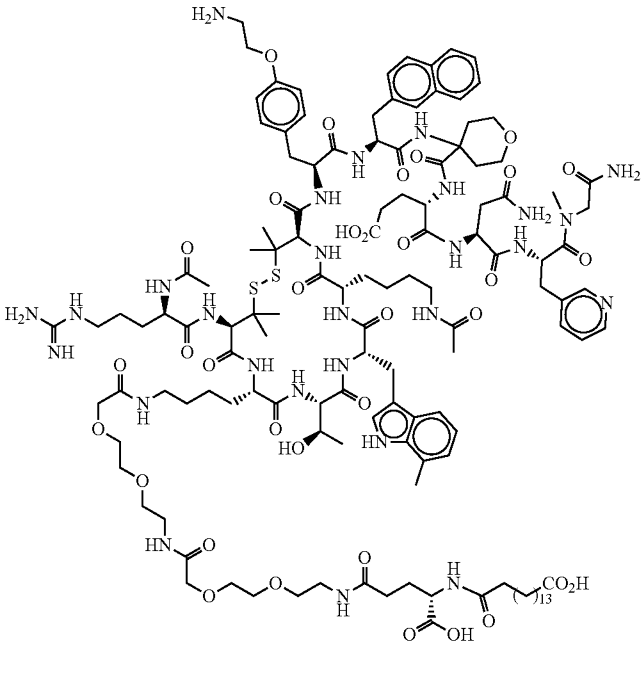 (Example 21) |

TABLE 1A-continued
| Compounds | |
|---|---|
| SEQ Id | Structure: |
| 22 | 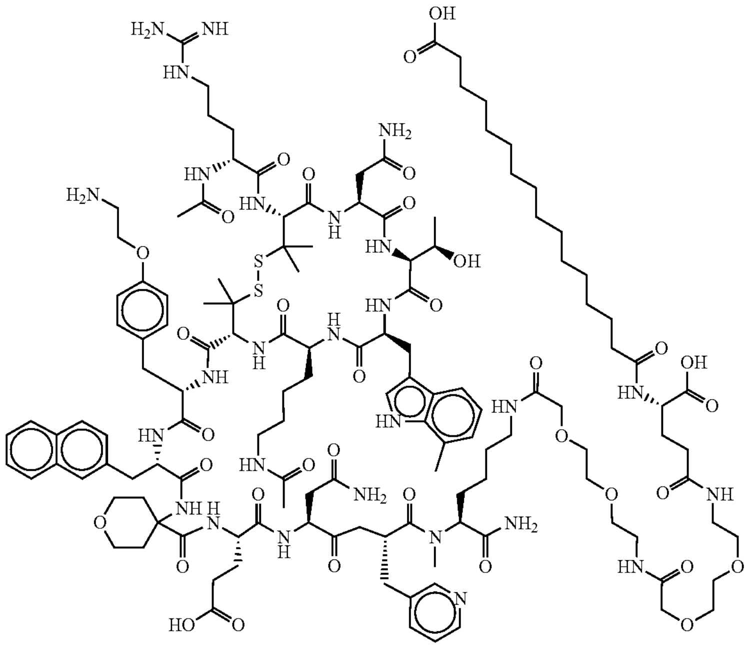 (Example 22) |
| 23 | 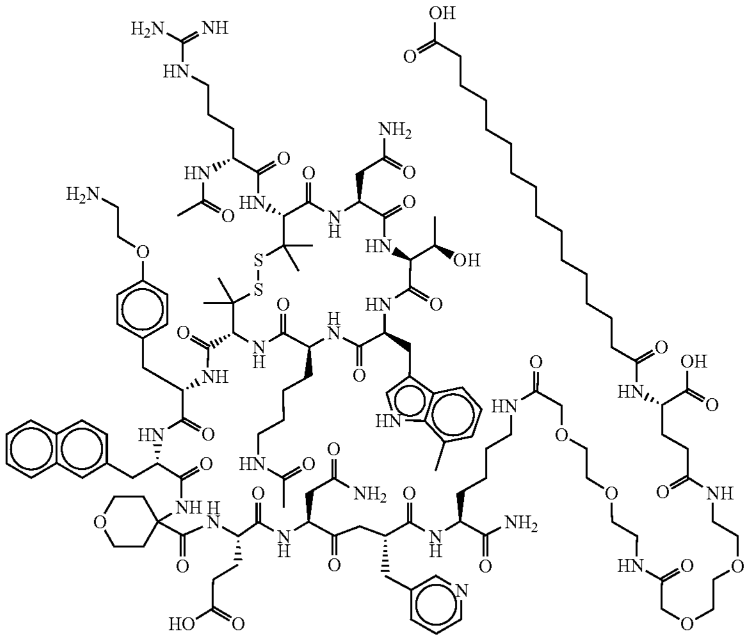 (Example 23) |

TABLE 1A-continued
| Compounds | |
|---|---|
| SEQ Id | Structure: |
| 24 | 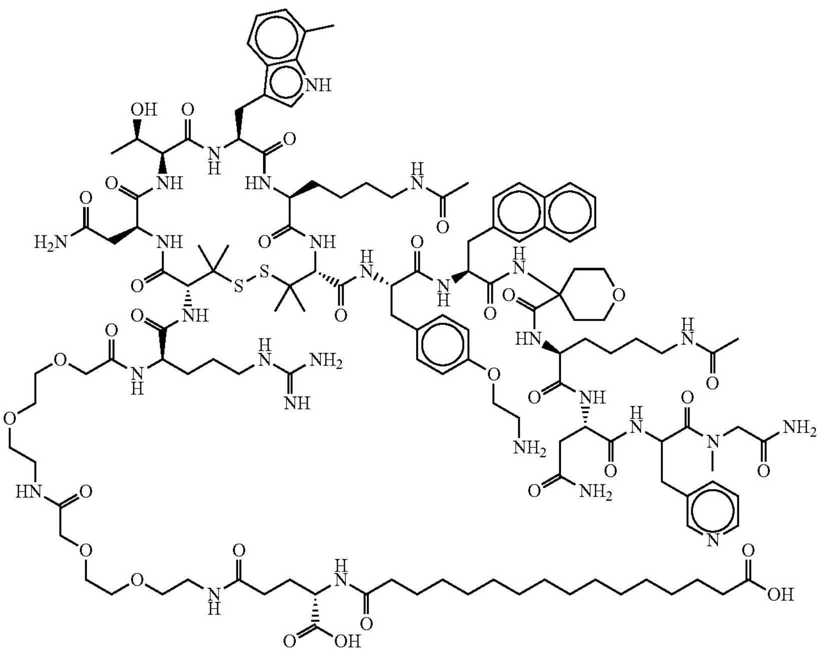 (Example 24) |
| 25 | 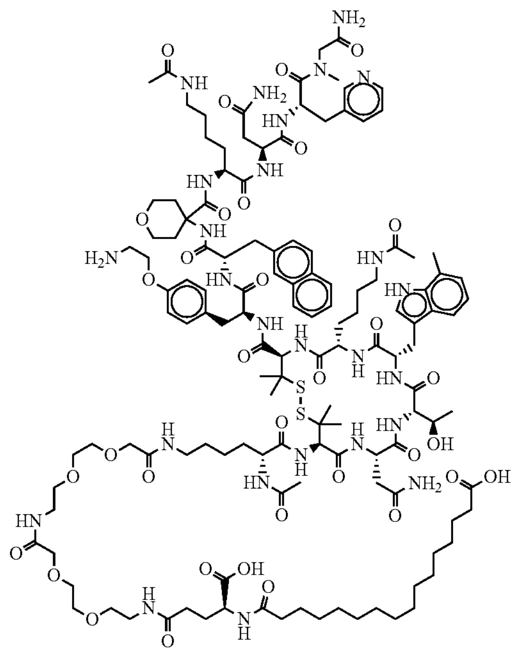 (Example 25) |

TABLE 1A-continued
| SEQ Id | Compounds<br>Structure: |
|---|---|
| 26 | 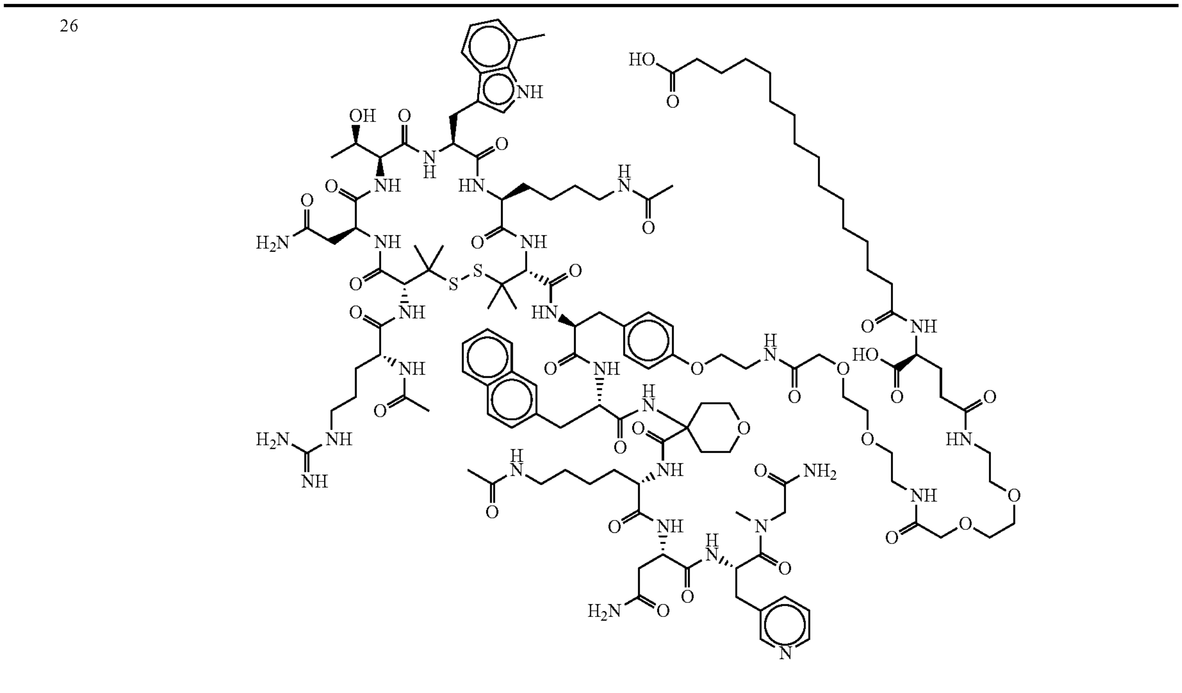<br>(Example 26) |
| 27 | 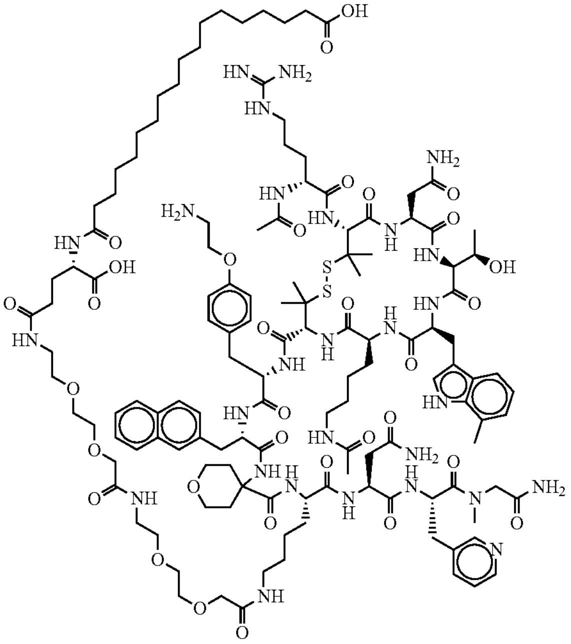<br>(Example 27) |
65
wherein Pen-Pen forms a disulfide bond, or Abu-C form a thioether bond.

TABLE 1B
| Compounds | |
|---|---|
| SEQ ID | Structure |
| 28 | 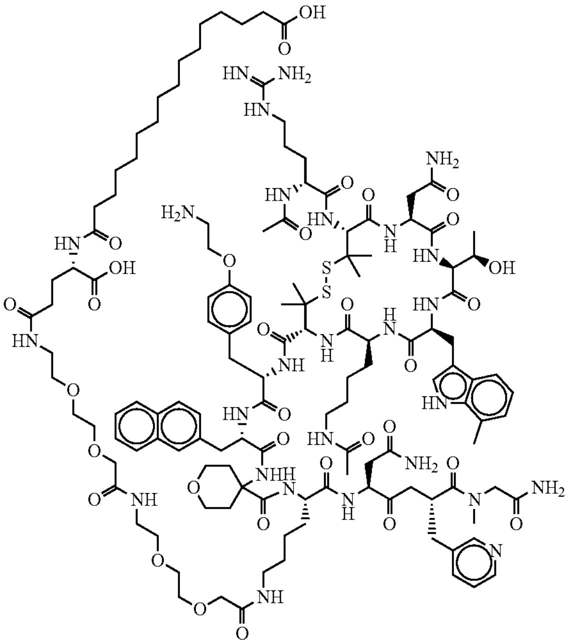 (Example 28) |
| 29 | 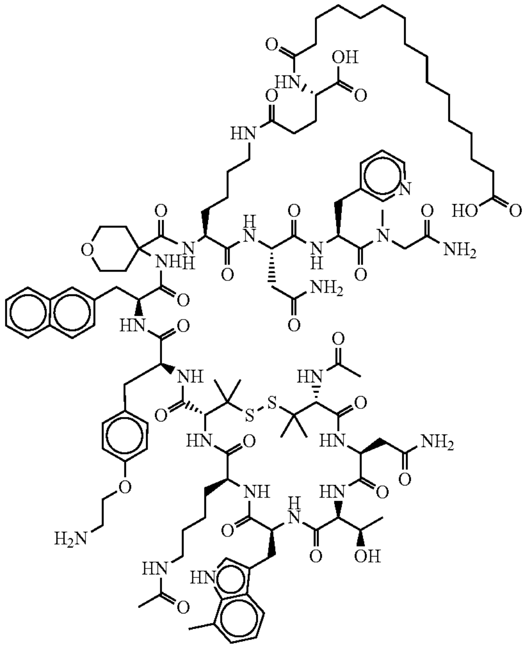 (Example 29) |

TABLE 1B-continued
| Compounds | |
|---|---|
| SEQ ID | Structure |
| 30 | 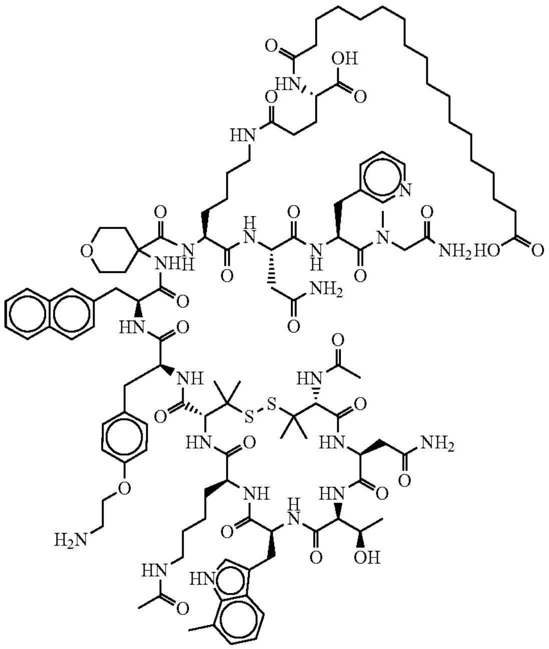 (Example 30) |
| 31 | 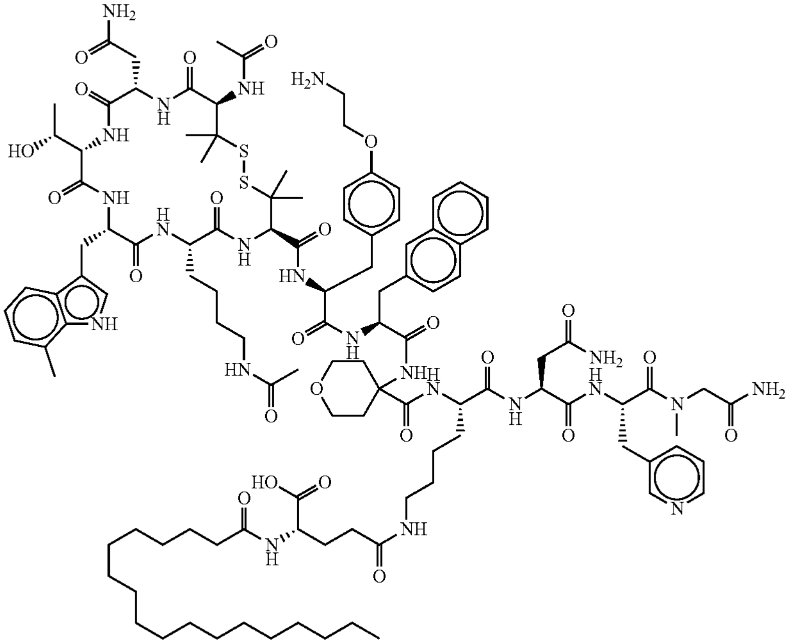 (Example 31) |

TABLE 1B-continued
| Compounds | |
|---|---|
| SEQ ID | Structure |
| 32 | 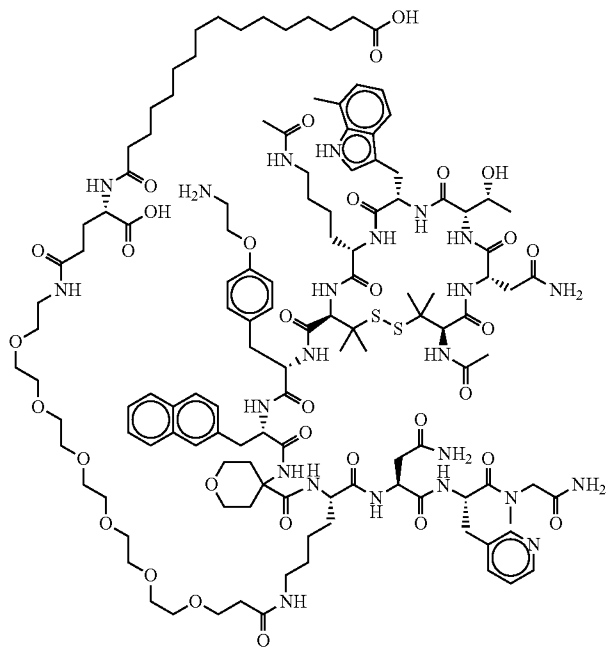<br>(Example 32) |
| 33 | 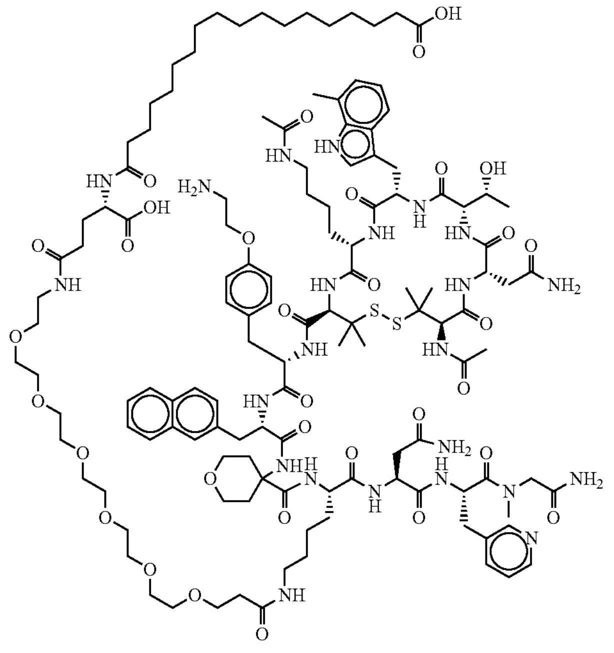<br>(Example 33) |

TABLE 1B-continued
| Compounds | |
|---|---|
| SEQ ID | Structure |
| 34 | 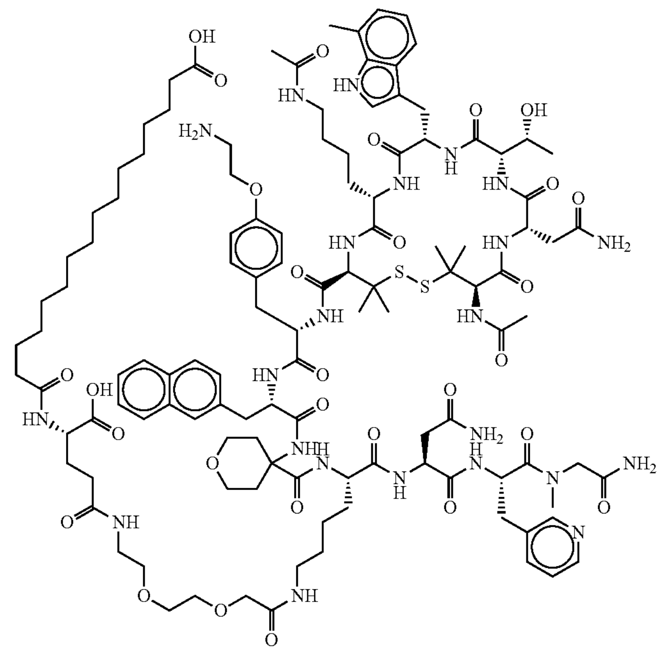 (Example 34) |
| 35 | 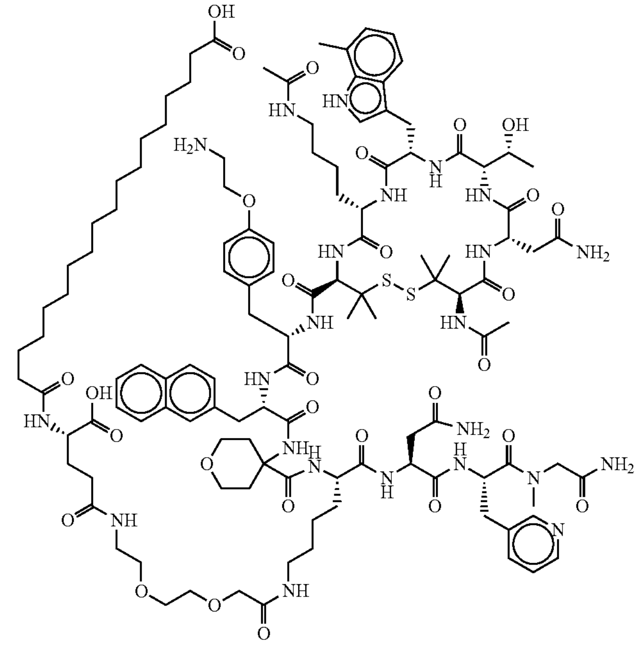 (Example 35) |

TABLE 1B-continued
| Compounds | |
|---|---|
| SEQ ID | Structure |
| 36 | 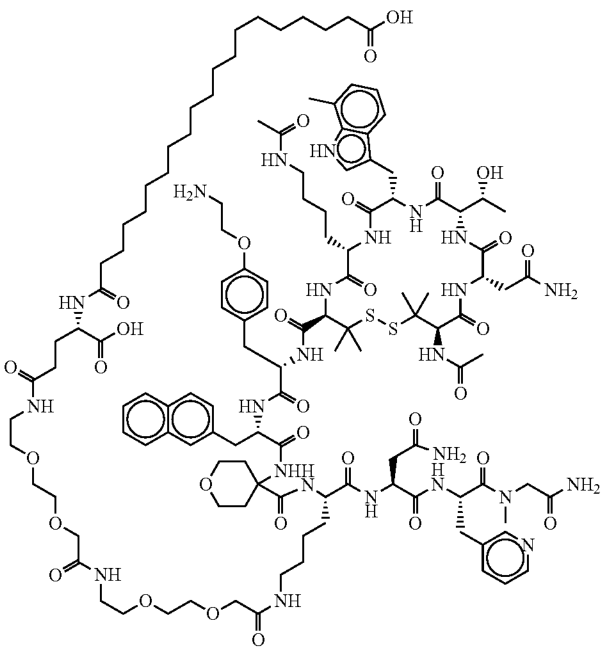 (Example 36) |
| 37 | 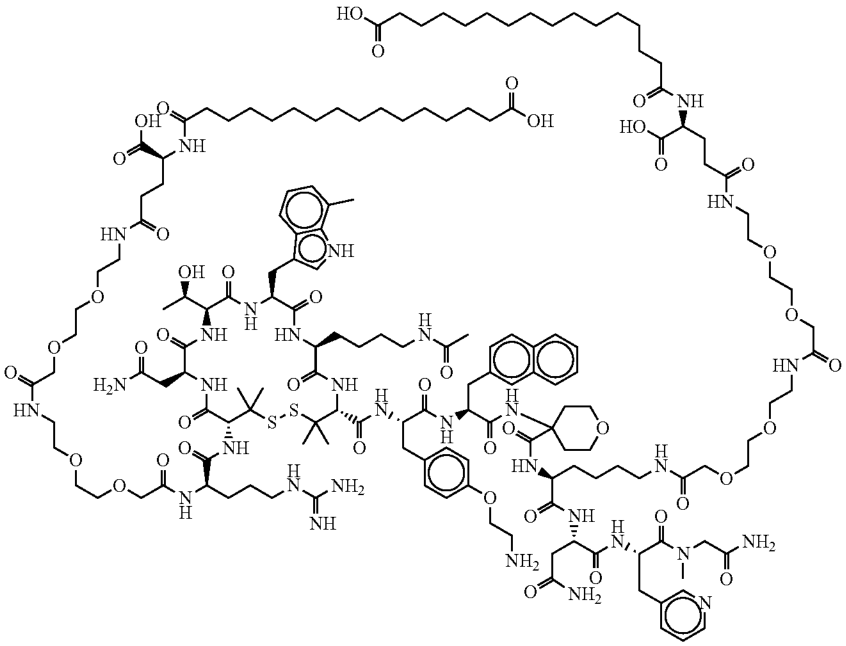 (Example 37) |

TABLE 1B-continued
| Compounds | |
|---|---|
| SEQ ID | Structure |
| 38 | 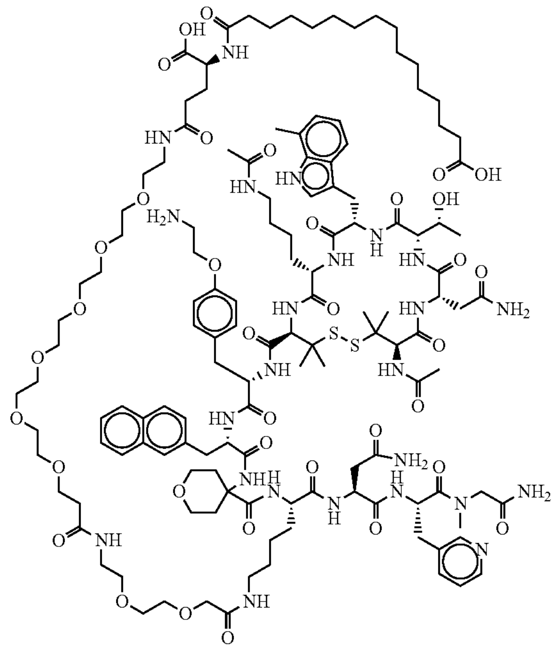 (Example 38) |
| 39 | 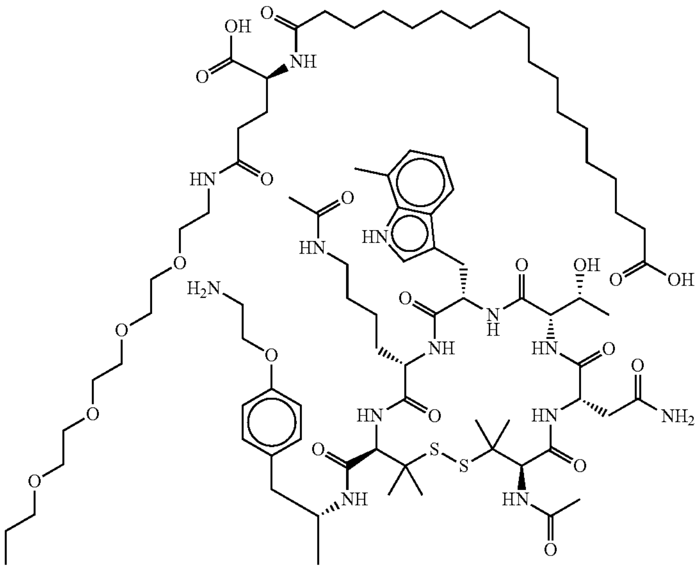 |

TABLE 1B-continued
| Compounds | |
|---|---|
| SEQ ID | Structure |
| | 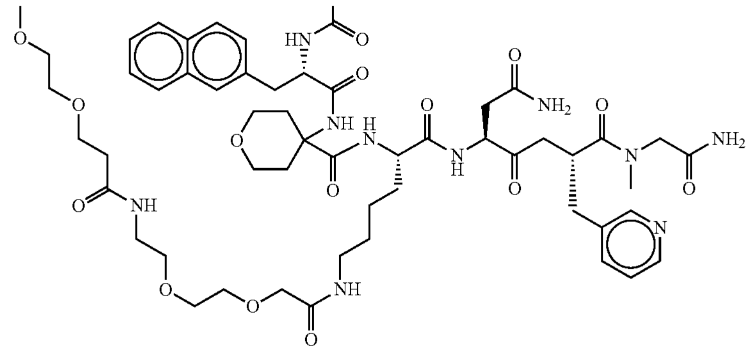<br>(Example 39) |
| 40 | 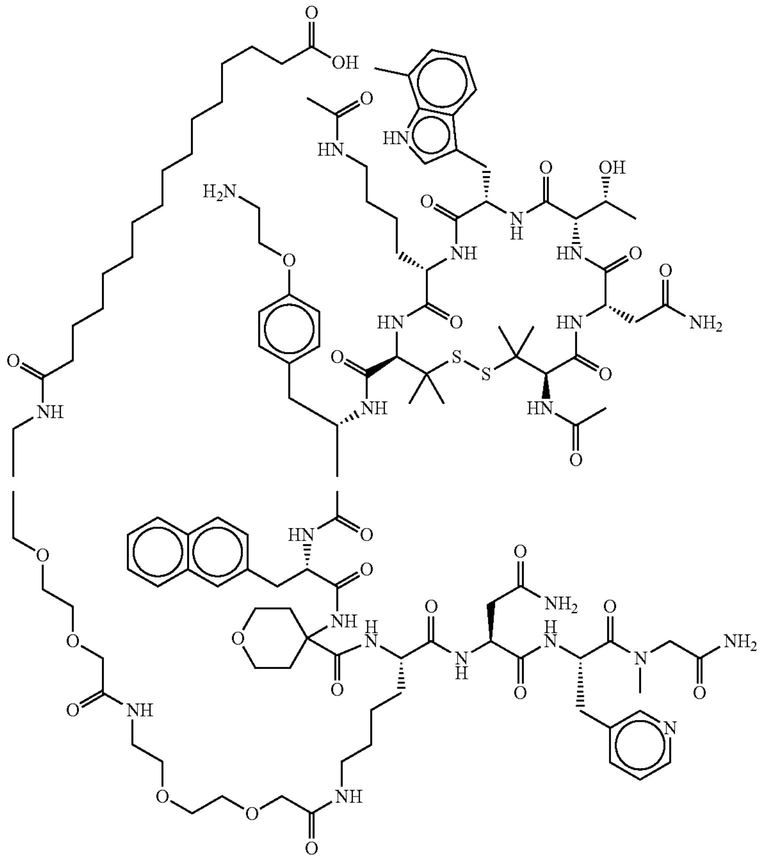<br>(Example 40) |

TABLE 1B-continued
| Compounds | |
|---|---|
| SEQ ID | Structure |
| 41 | 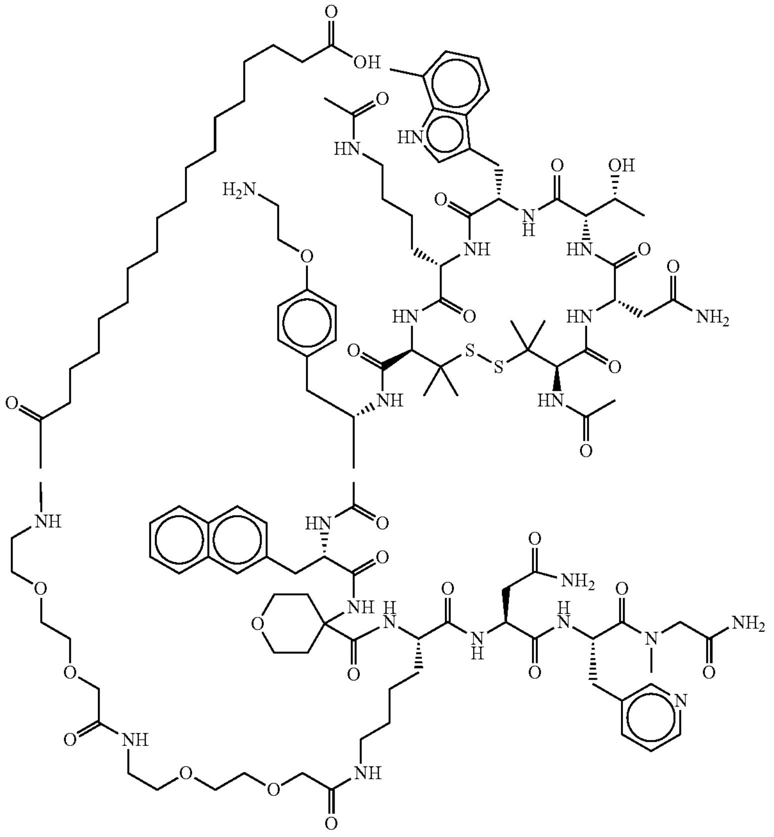<br>(Example 41) |
| 42 | 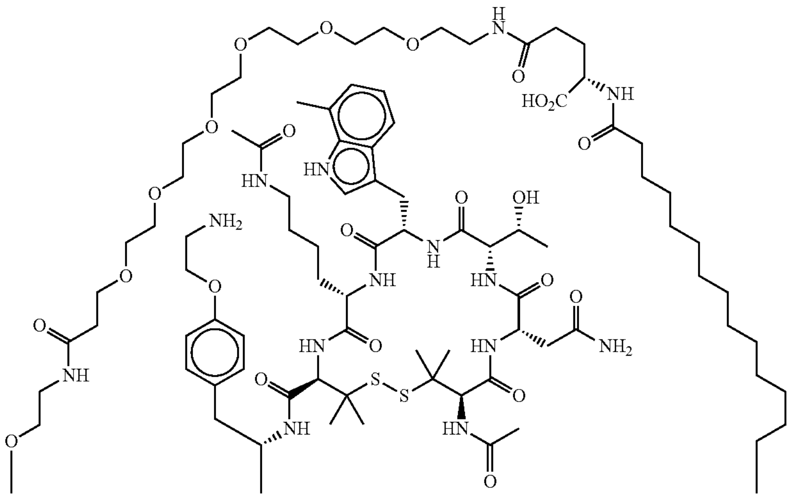 |

TABLE 1B-continued
| Compounds | |
|---|---|
| SEQ ID | Structure |
| | 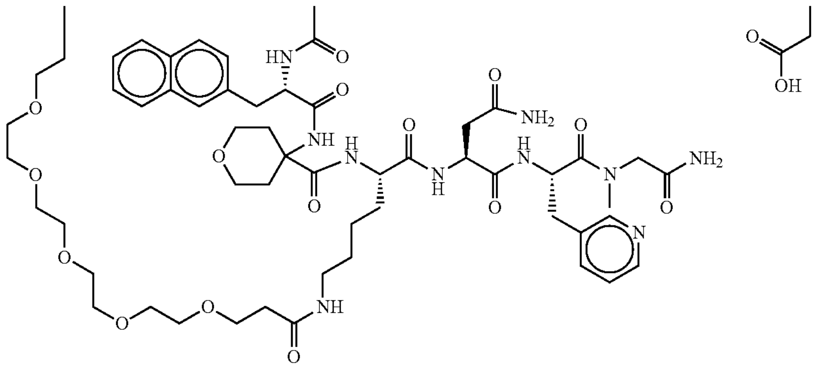 (Example 42) |
| 43 | 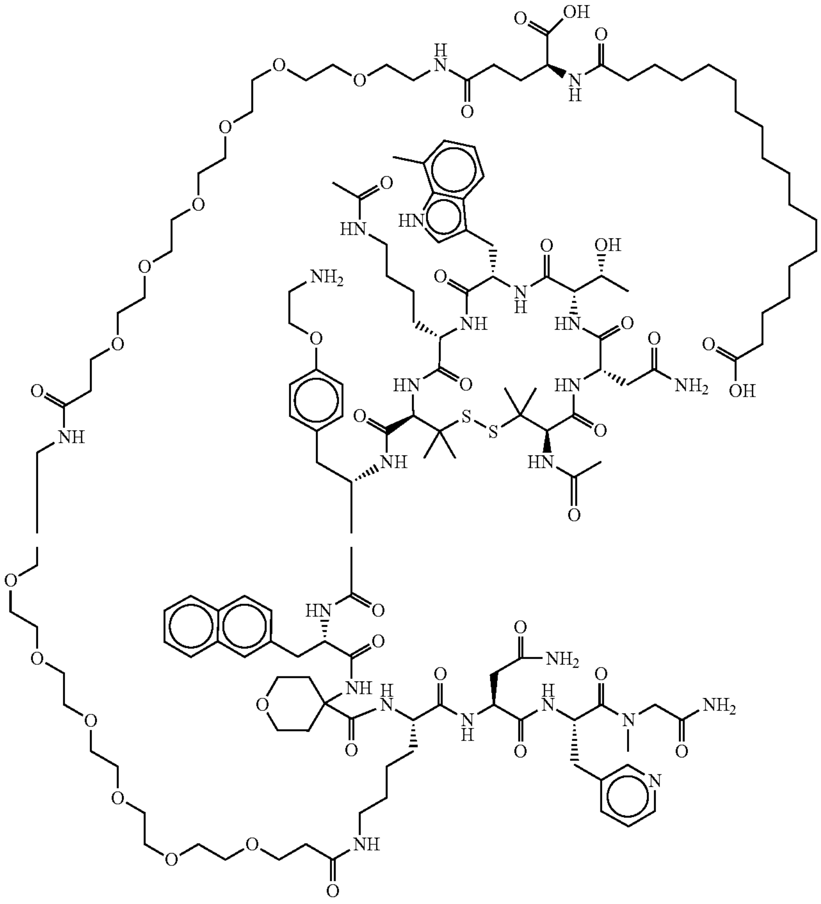 (Example 43) |

TABLE 1B-continued
| Compounds | |
|---|---|
| SEQ ID | Structure |
| 44 | 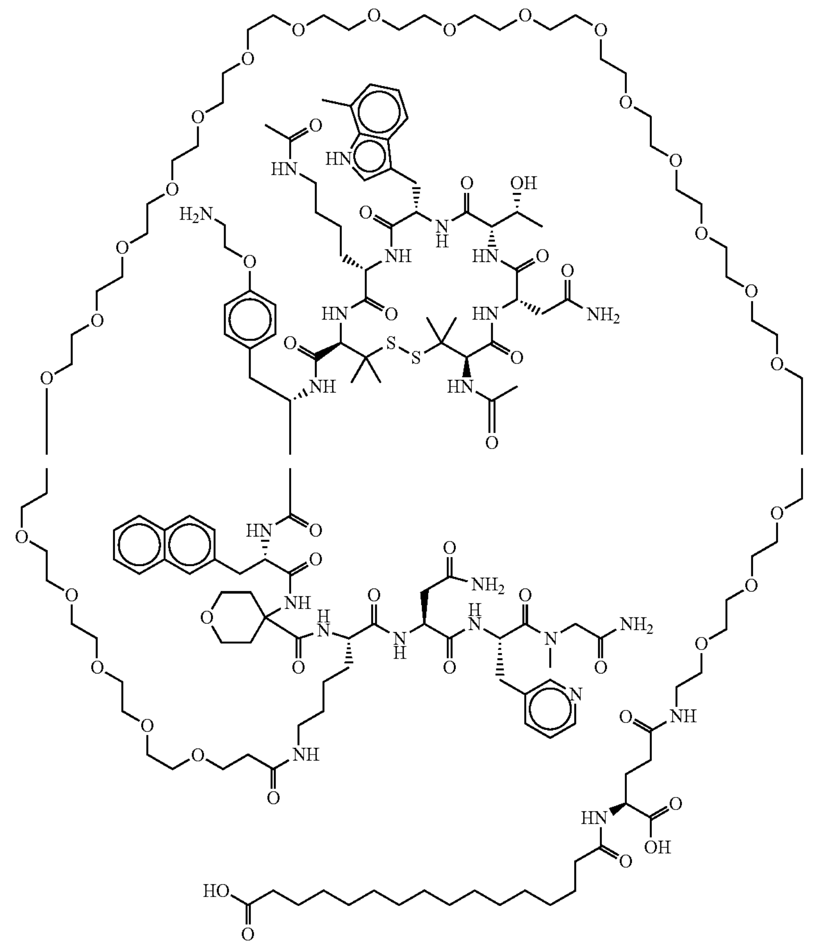 (Example 44) |
| 45 | 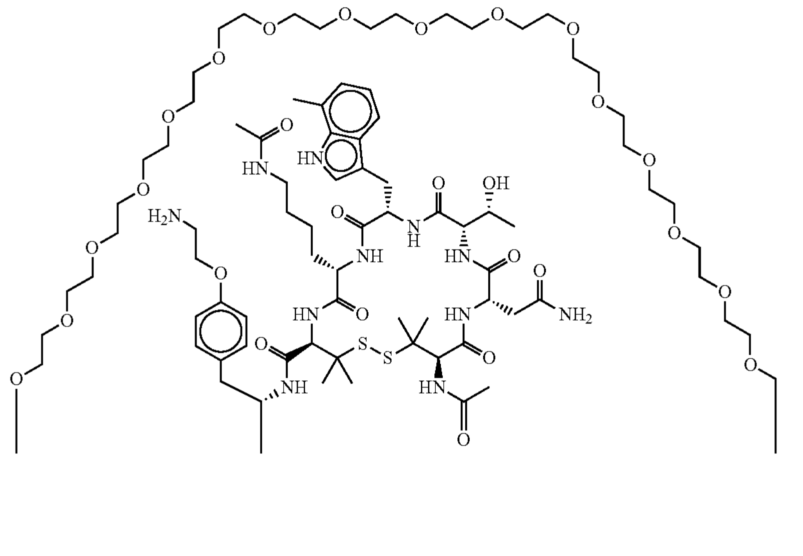 |

TABLE 1B-continued
| Compounds | |
|---|---|
| SEQ ID | Structure |
| | 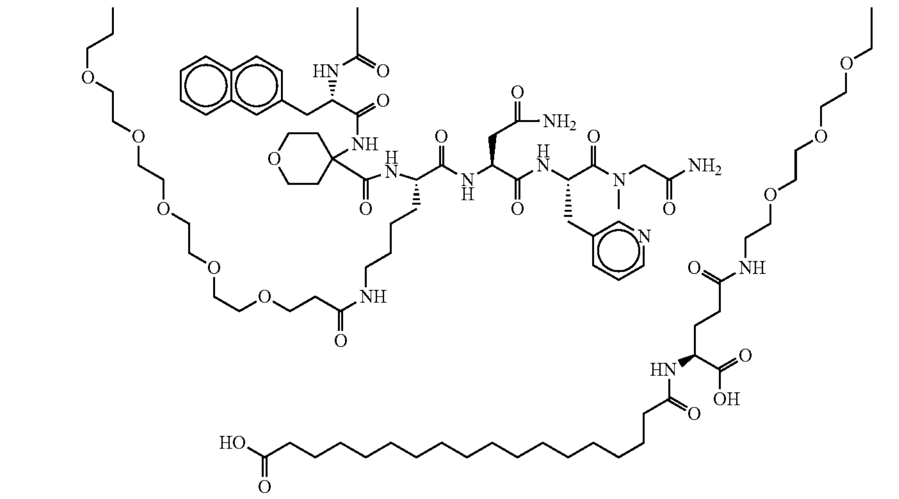 |
| | (Example 45) |
| 46 | 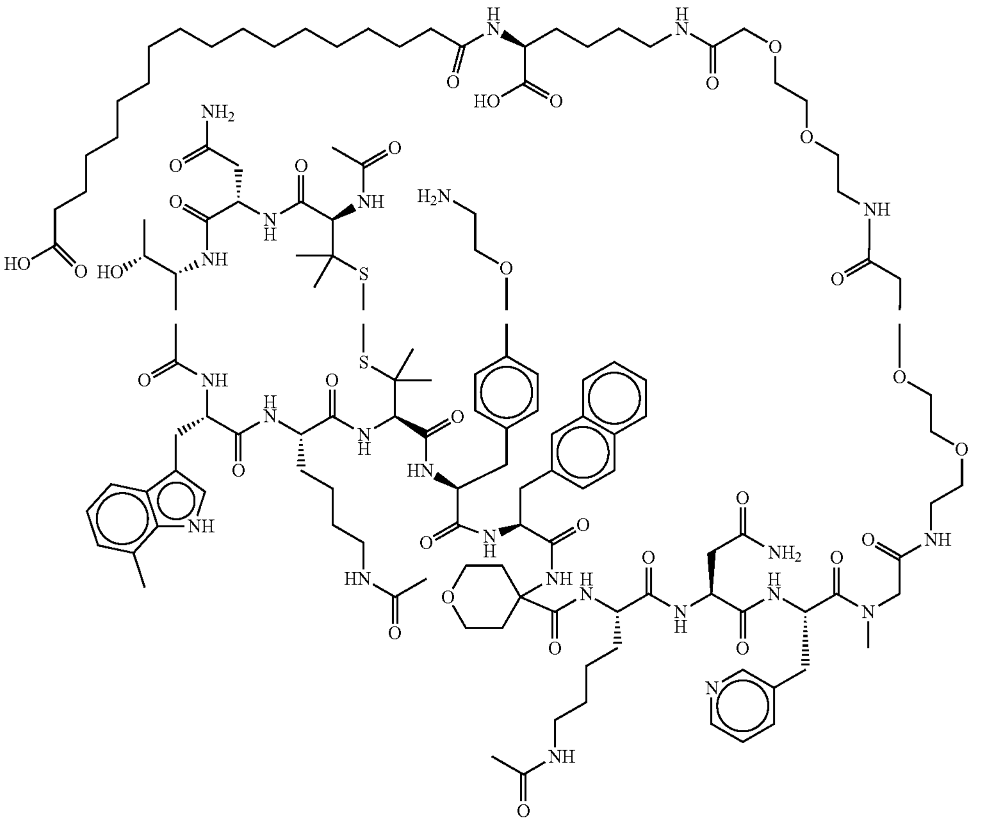 |
| | (Example 46) |

TABLE 1B-continued
| SEQ ID | Structure |
|---|---|
| 47 | 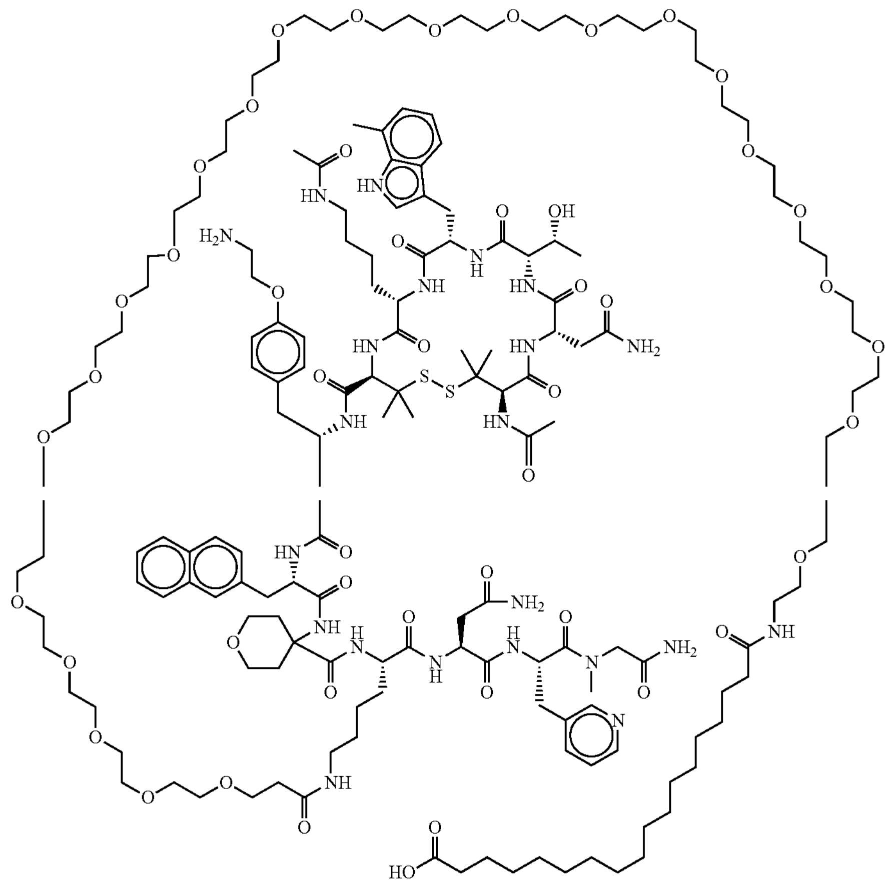 (Example 47) |
| 48 | 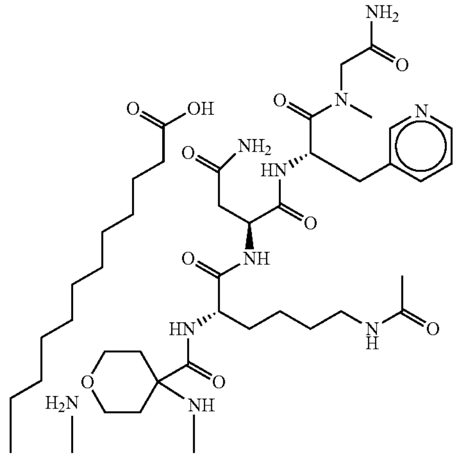 |

TABLE 1B-continued
| Compounds | |
|---|---|
| SEQ ID | Structure |
| | 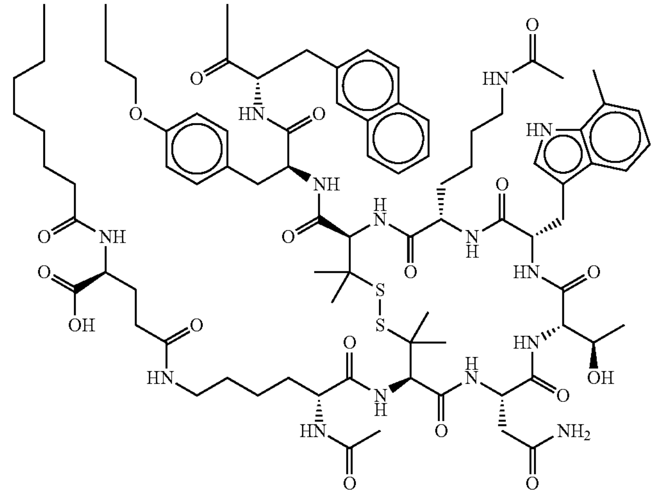 (Example 48) |
| 49 | 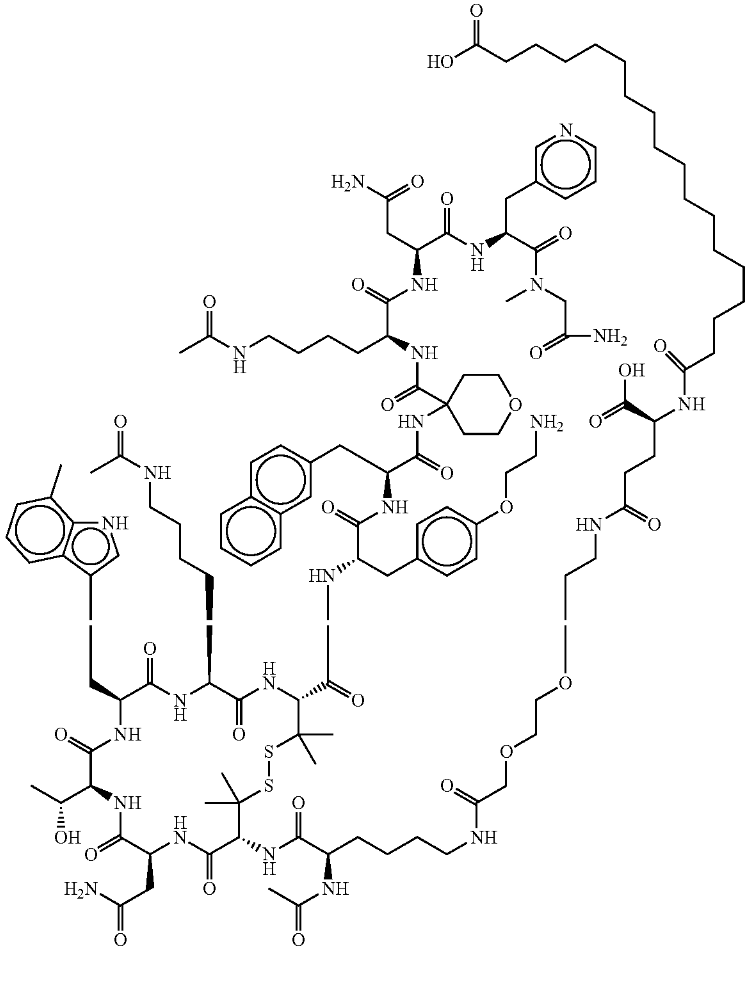 (Example 49) |

TABLE 1B-continued
| Compounds | |
|---|---|
| SEQ ID | Structure |
| 50 | 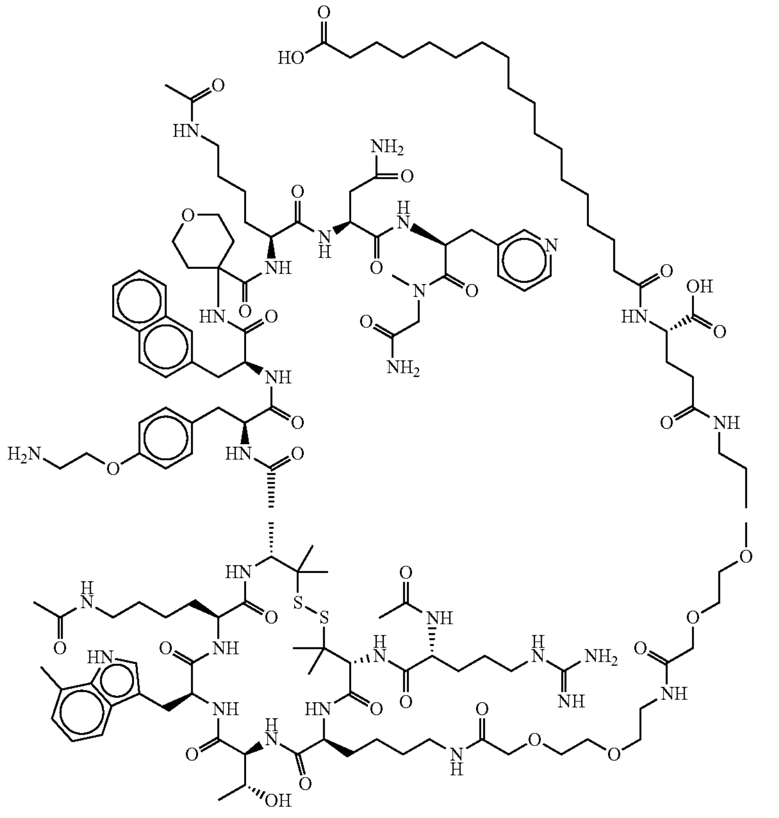 (Example 50) |
| 51 | 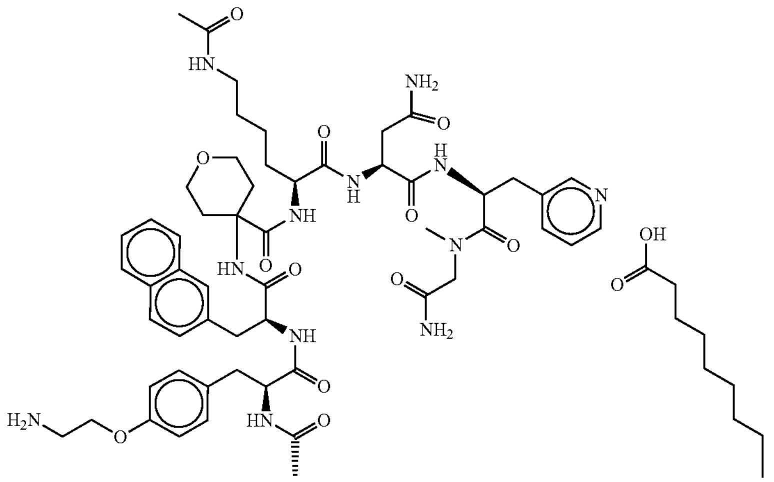 |

TABLE 1B-continued
| Compounds | |
|---|---|
| SEQ ID | Structure |
| | 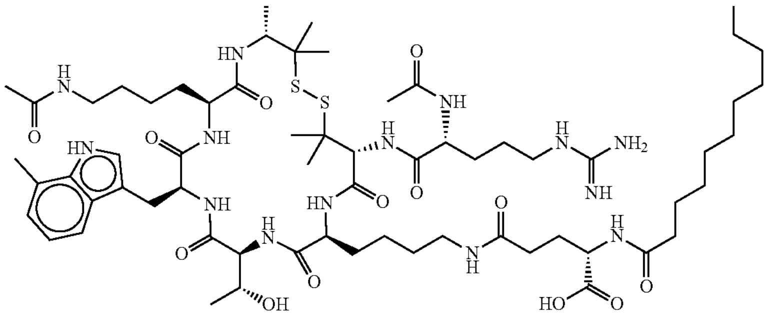 |
| | (Example 51) |
| 52 | 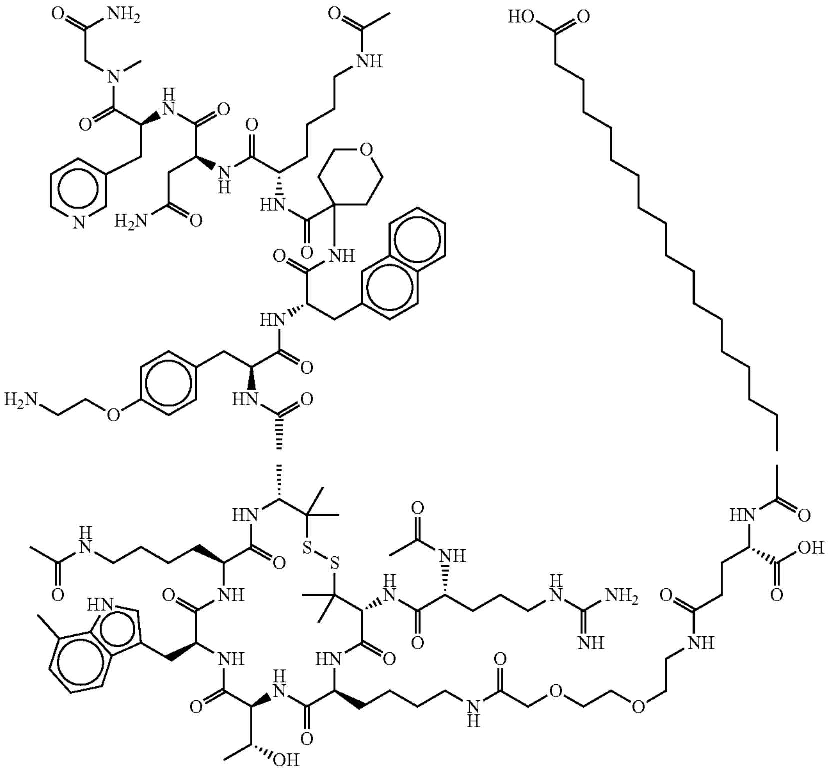 |
| | (Example 52) |

TABLE 1B-continued
| Compounds | |
|---|---|
| SEQ ID | Structure |
| 53 | 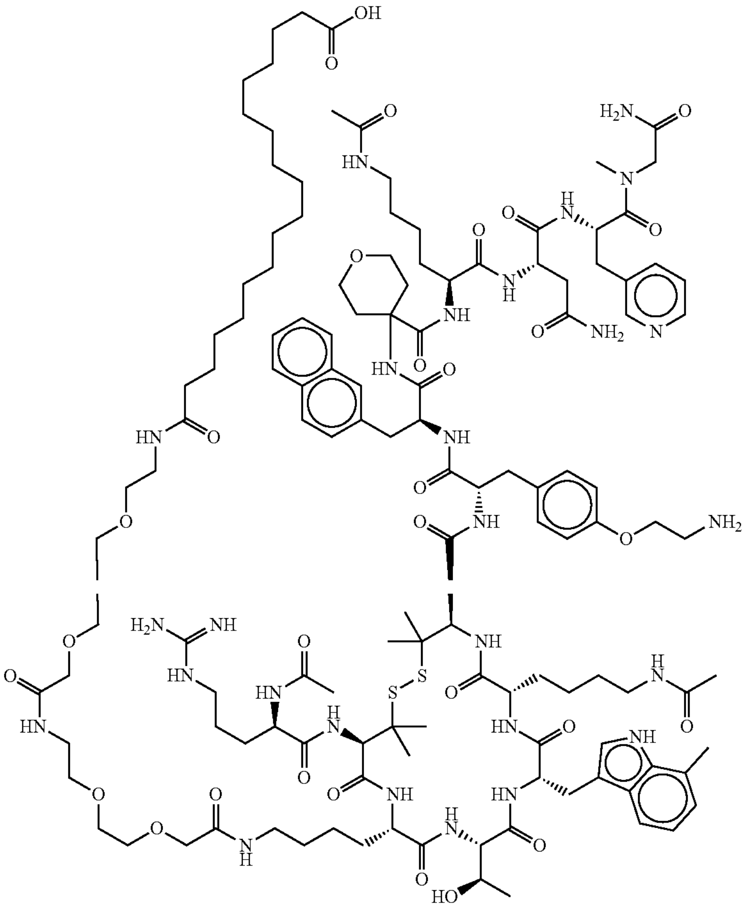 (Example 53) |

TABLE 1C
| Compounds | |
|---|---|
| SEQ ID | Structure |
| 54 | 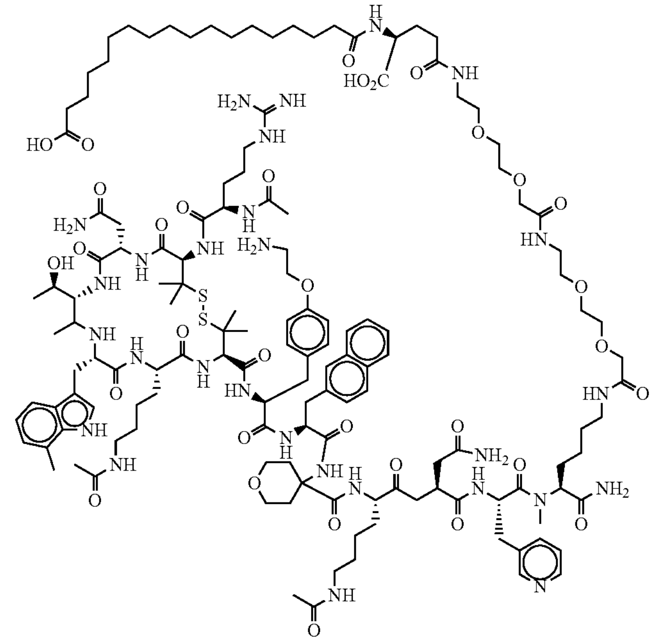 (Example 54) |
| 55 | 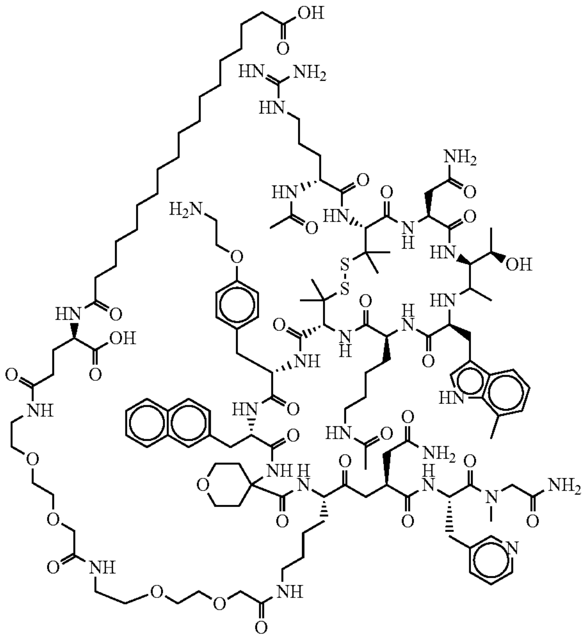 (Example 55) |

TABLE 1C-continued
| Compounds | |
|---|---|
| SEQ ID | Structure |
| 56 | 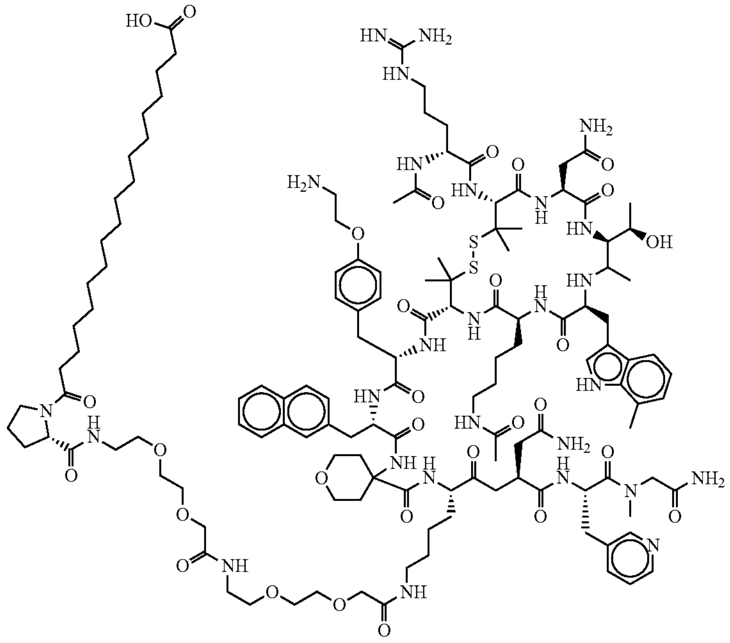<br>(Example 56) |
| 57 | 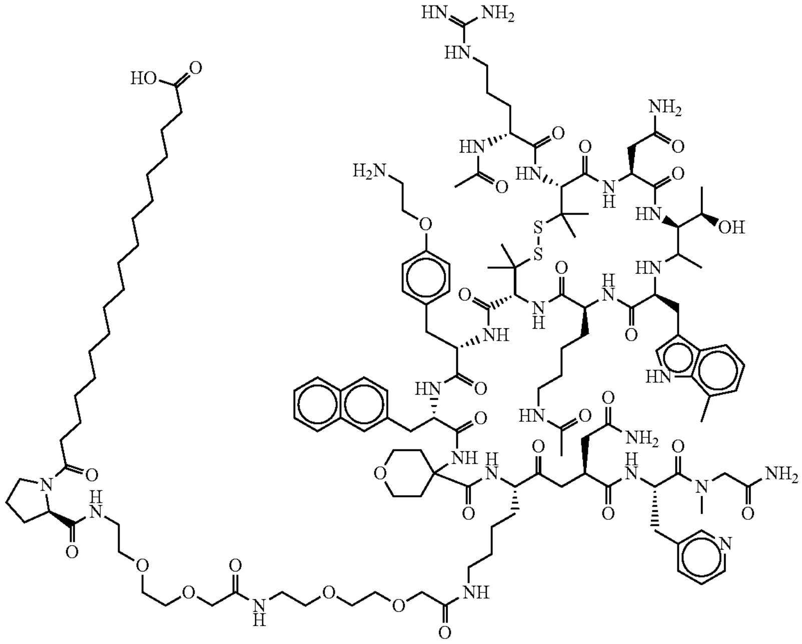<br>(Example 57) |

TABLE 1C-continued
| Compounds | |
|---|---|
| SEQ ID | Structure |
| 58 | 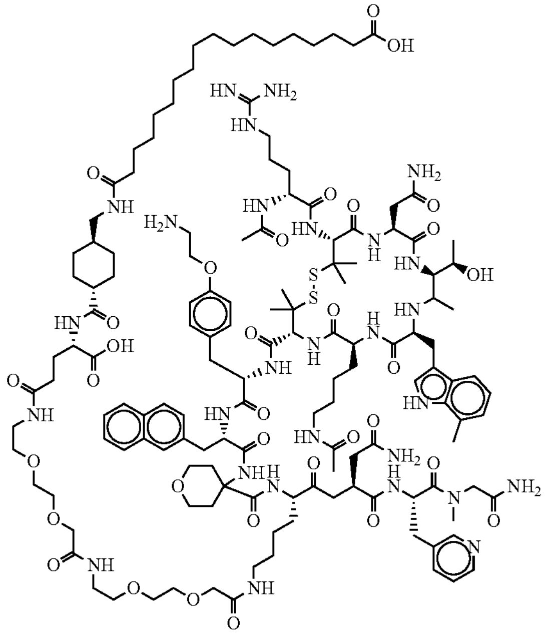 (Example 58) |
| 59 | 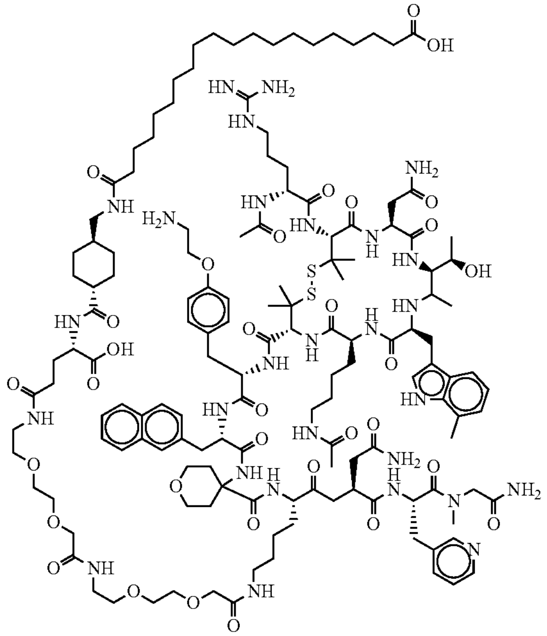 (Example 59) |

TABLE 1C-continued
| Compounds | |
|---|---|
| SEQ ID | Structure |
| 60 | 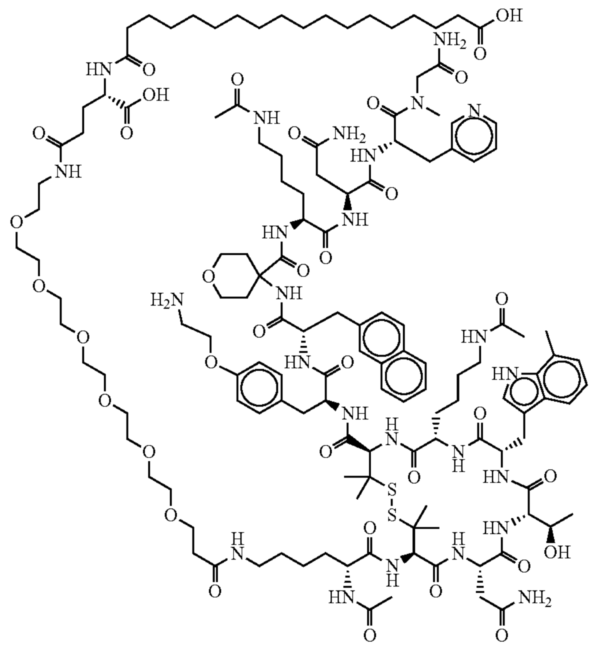 (Example 60) |
| 61 | 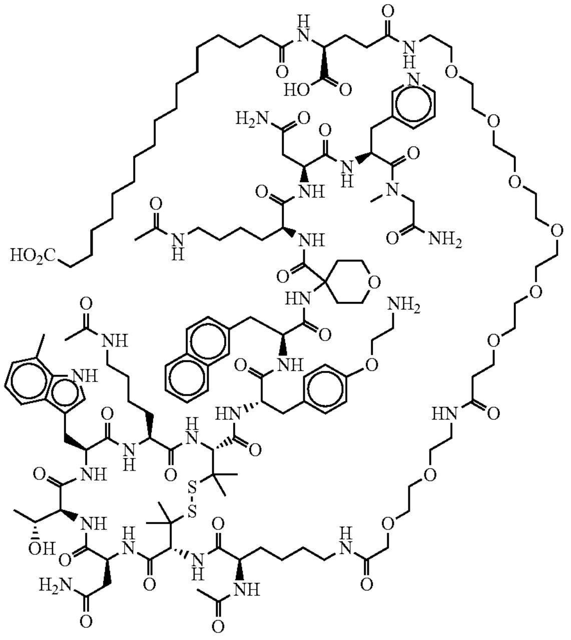 (Example 61) |

TABLE 1C-continued
| Compounds | |
|---|---|
| SEQ ID | Structure |
| 62 | 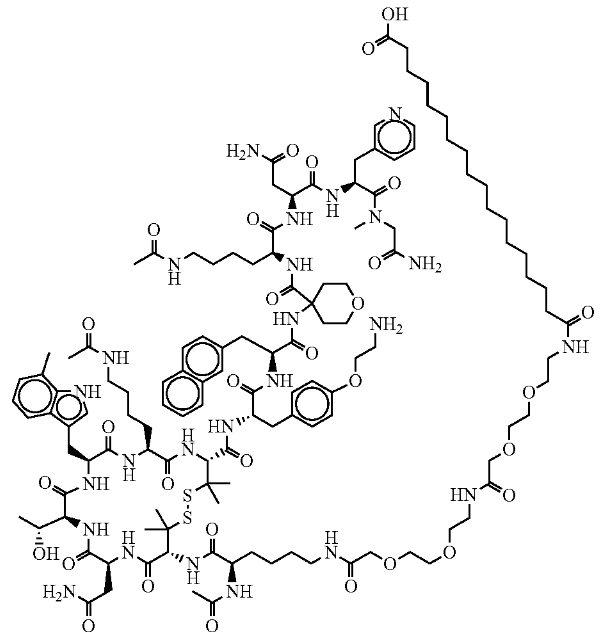<br>(Example 62) |
| 63 | 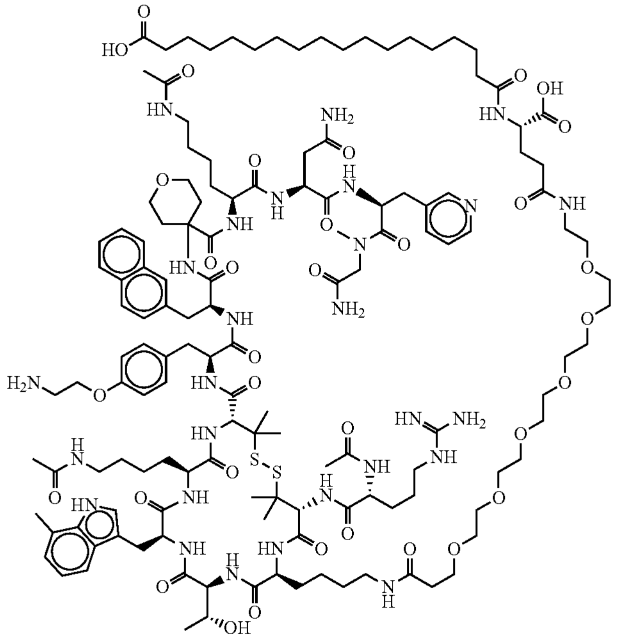<br>(Example 63) |

TABLE 1C-continued
| Compounds | |
|---|---|
| SEQ ID | Structure |
| 64 | 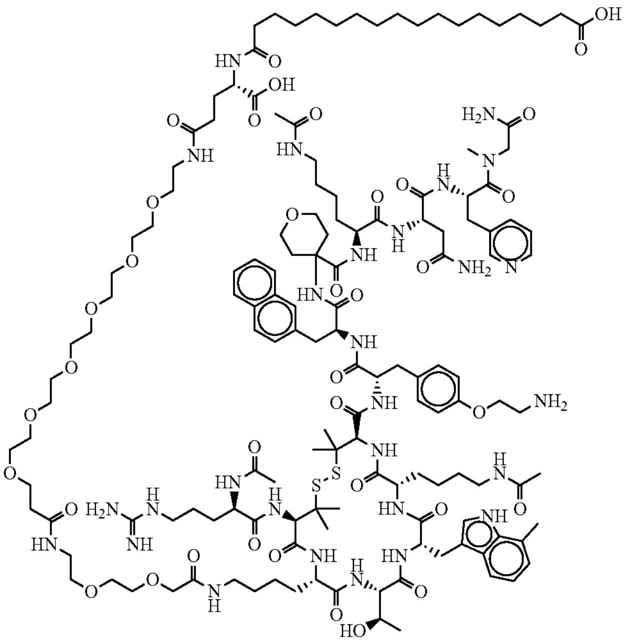 (Example 64) |
| 65 | 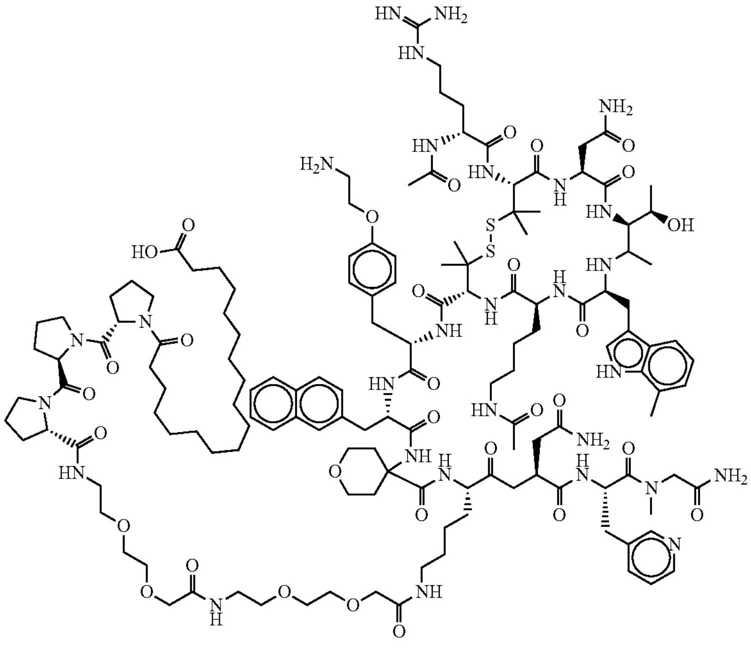 (Example 65) |

TABLE 1C-continued
| Compounds | |
|---|---|
| SEQ ID | Structure |
| 66 | 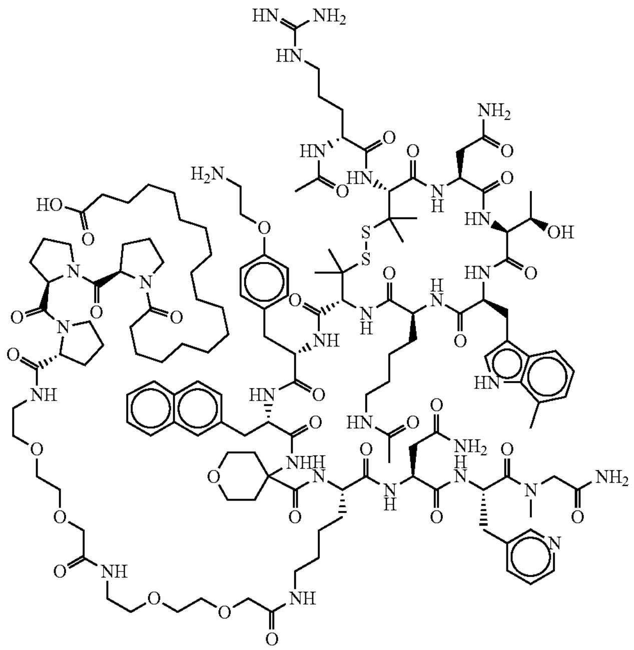<br>(Example 66) |
| 67 | 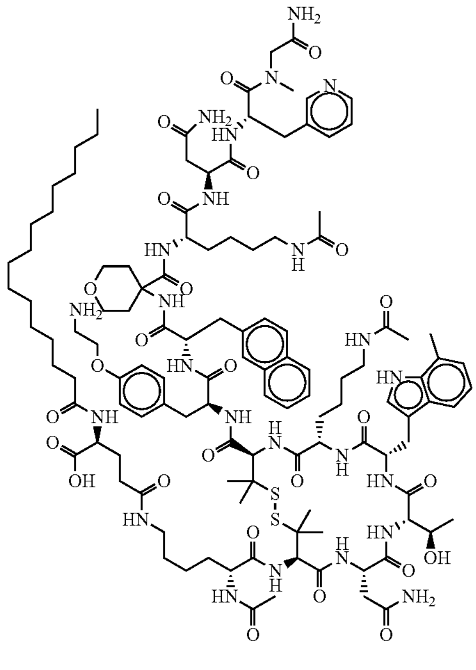<br>(Example 67) |

TABLE 1C-continued
| Compounds | |
|---|---|
| SEQ ID | Structure |
| 68 | 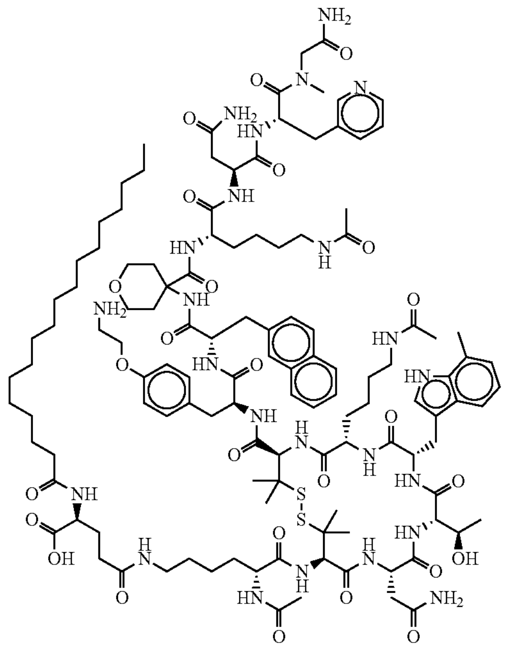 (Example 68) |
| 69 | 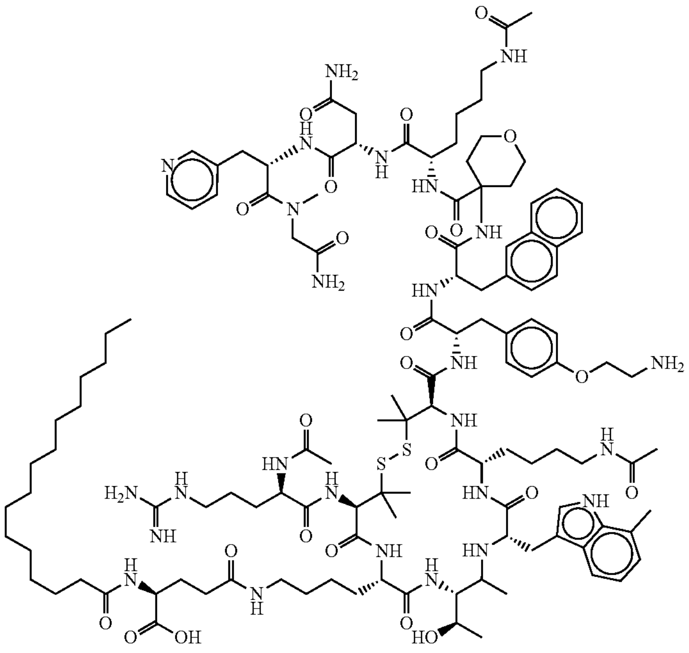 (Example 69) |

TABLE 1C-continued
| Compounds | |
|---|---|
| SEQ ID | Structure |
| 70 | 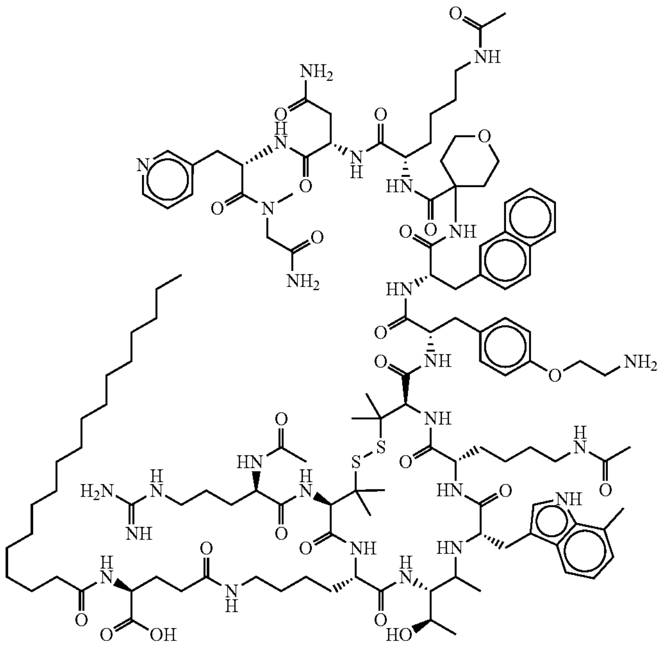 (Example 70) |
| 71 | 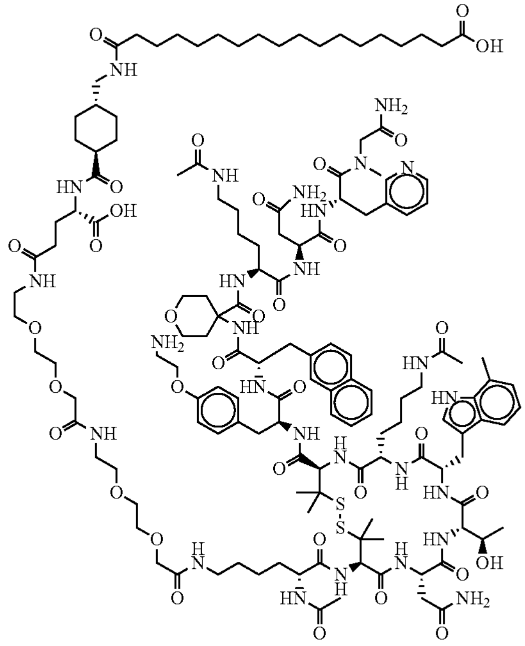 (Example 71) |

TABLE 1C-continued
| Compounds | |
|---|---|
| SEQ ID | Structure |
| 72 | 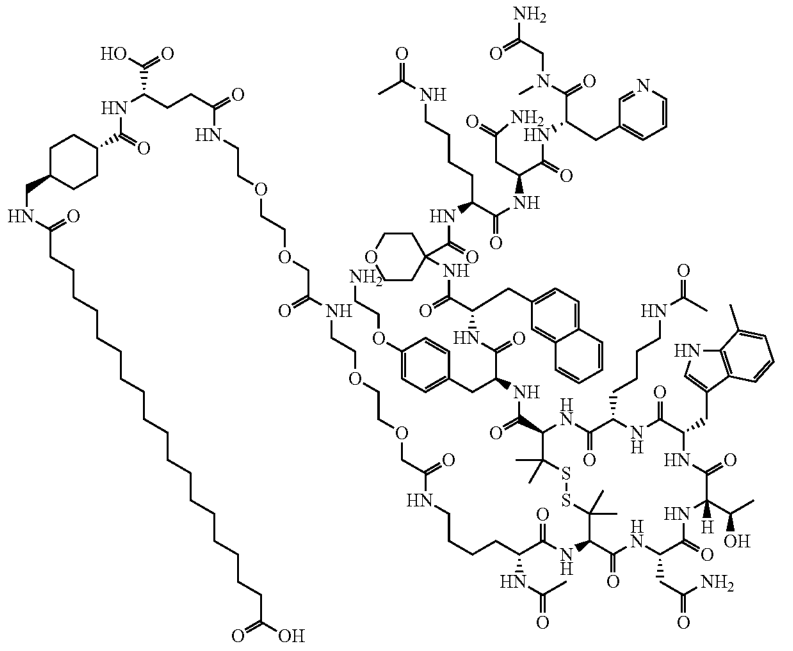 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)COCCOCCNC(=O)COCCOCCNC(=O)CC[C@H](NC(=O)[C@H]2CC[C@H](CNC(=O)CCCCCCCCCCCCCCCCCCC(=O)O)CC2)C(=O)O)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC1=O] (Example 72) |
| 73 | 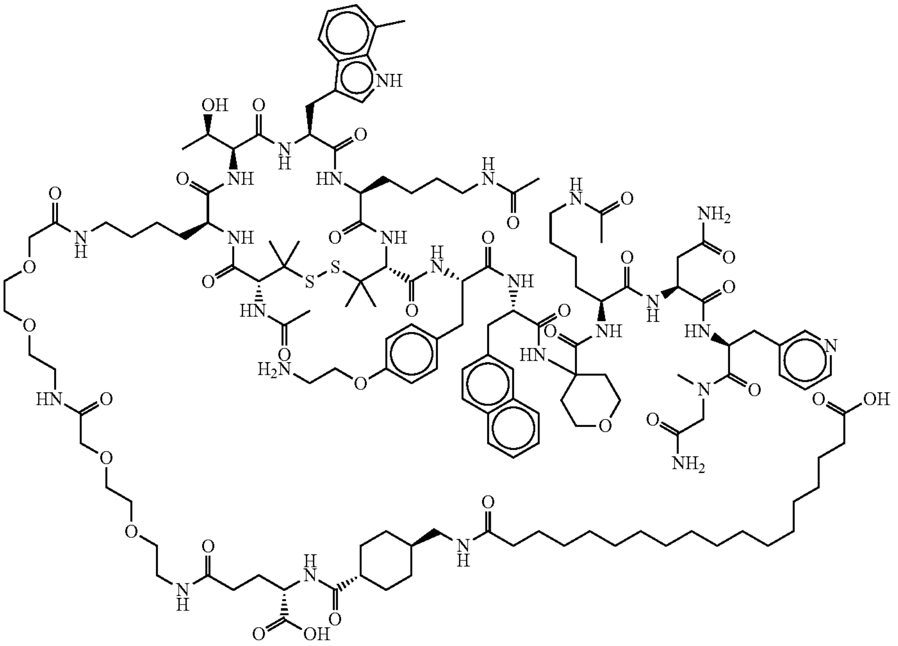 (Example 73) |

TABLE 1C-continued
| Compounds | |
|---|---|
| SEQ ID | Structure |
| 74 | 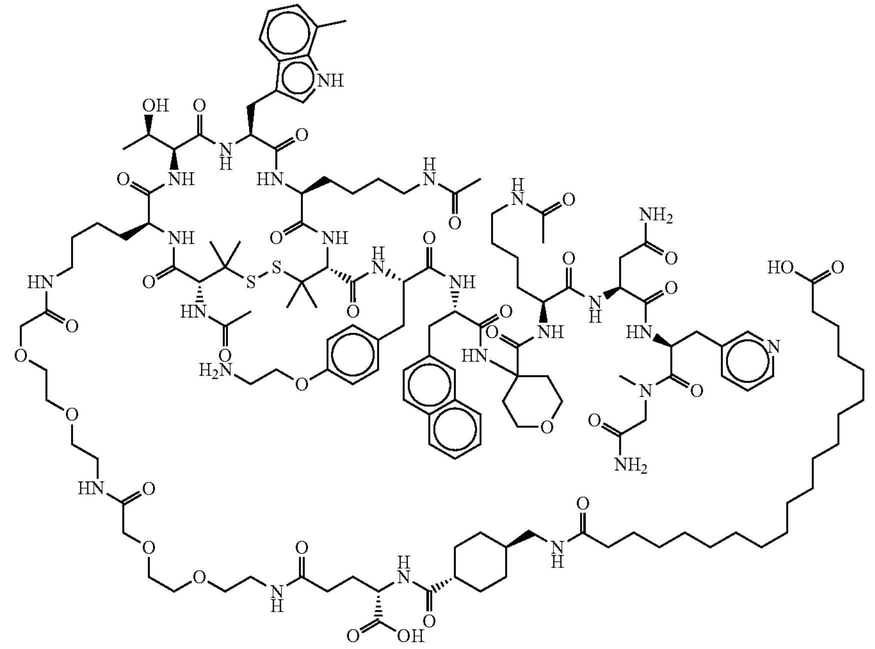<br>(Example 74) |
| 75 | 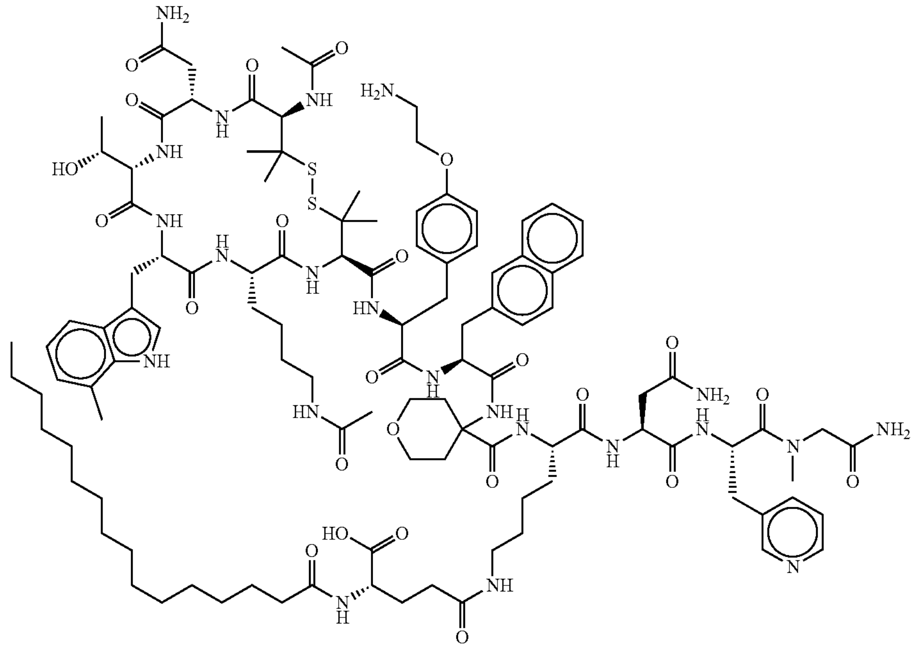<br>(Example 75) |

TABLE 1C-continued
| Compounds | |
|---|---|
| SEQ ID | Structure |
| 76 | 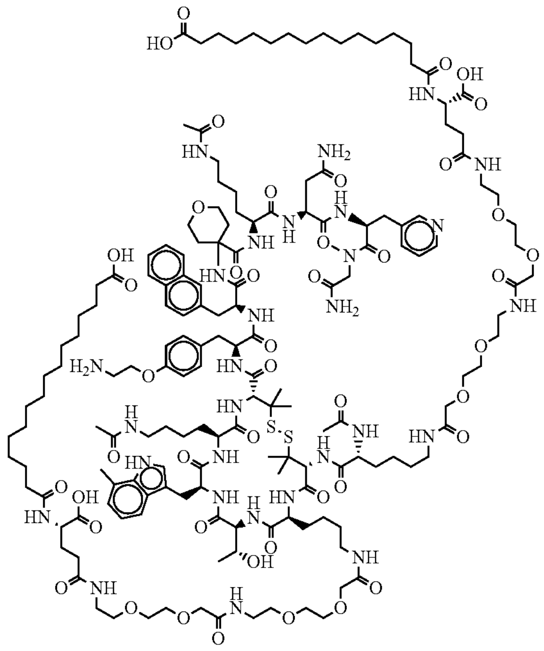 (Example 76) |
| 77 | 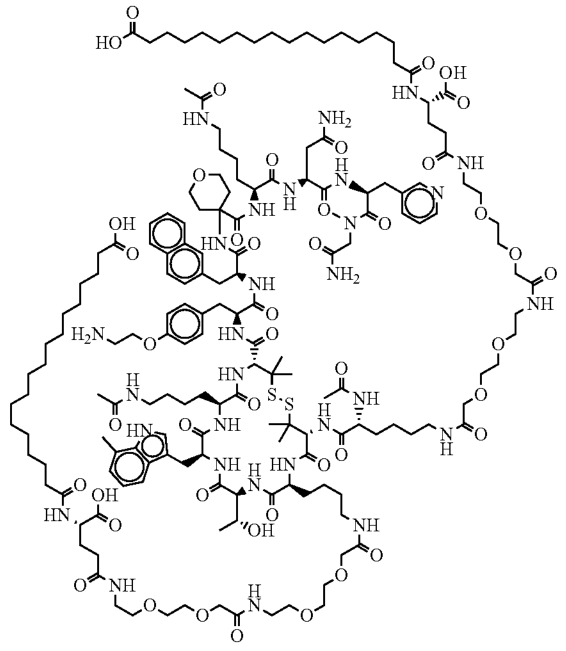 (Example 77) |

TABLE 1C-continued
| Compounds | |
|---|---|
| SEQ ID | Structure |
| 78 | 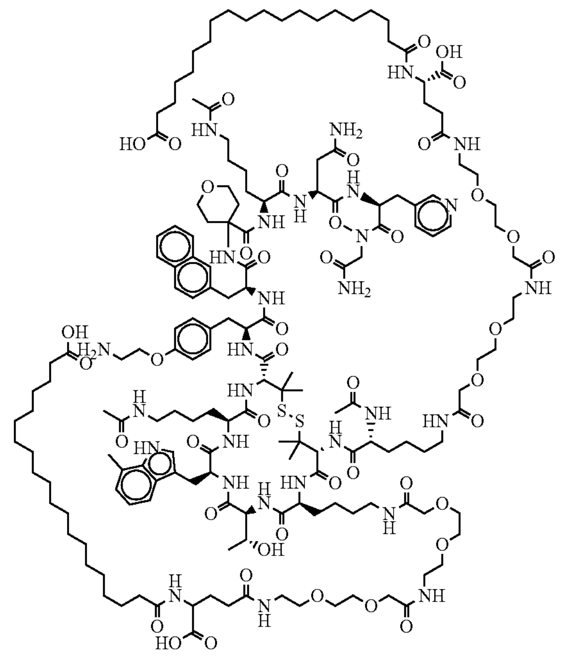<br>(Example 78) |
| 79 | 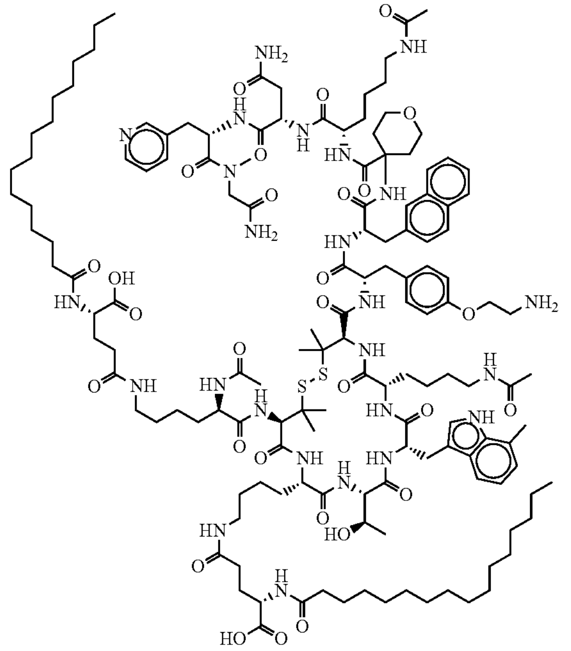<br>(Example 79) |

TABLE 1C-continued
| SEQ ID | Compounds<br>Structure |
|---|---|
| 80 | 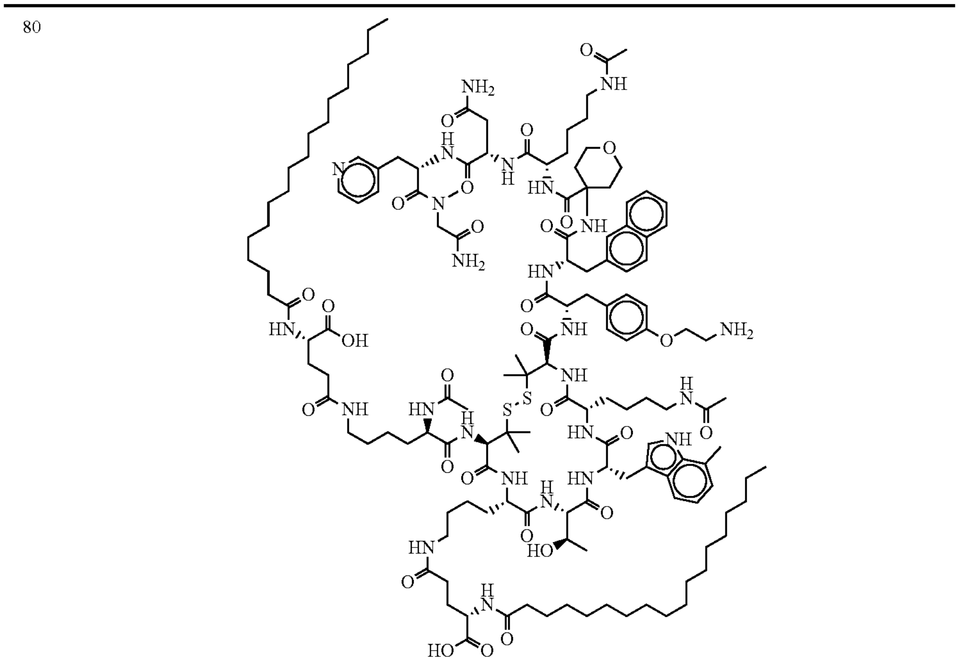 (Example 80) |
TABLE 1D
| SEQ ID | Compounds<br>Structure |
|---|---|
| 81 | 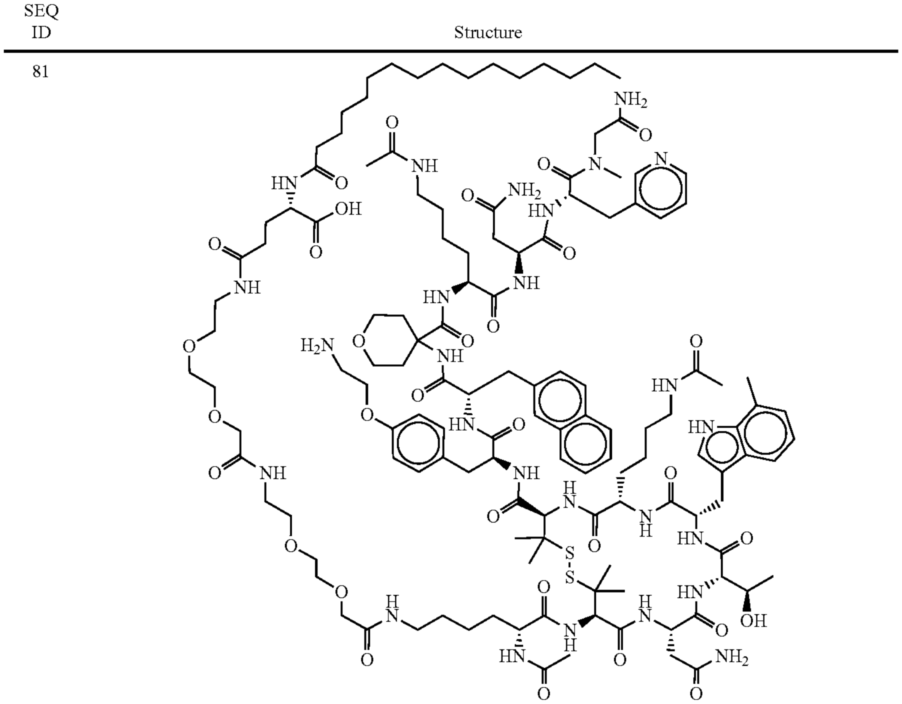 (Example 81) |

TABLE 1D-continued
| Compounds | |
|---|---|
| SEQ ID | Structure |
| 82 | 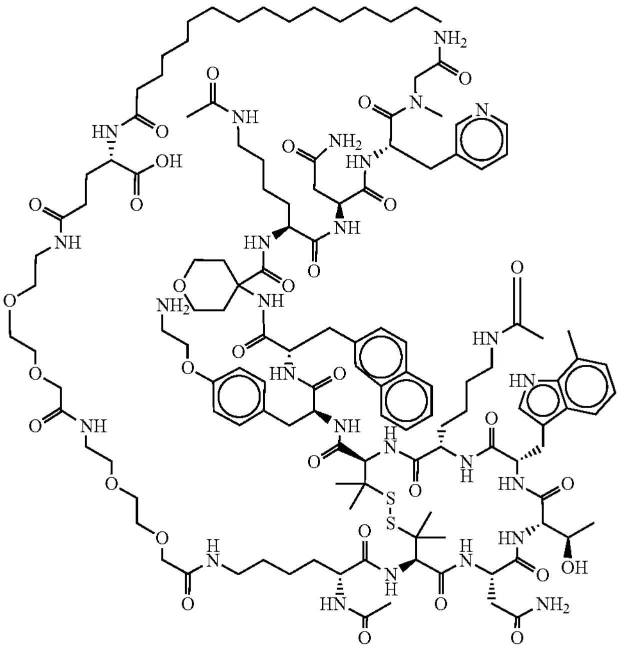<br>(Example 82) |
| 83 | 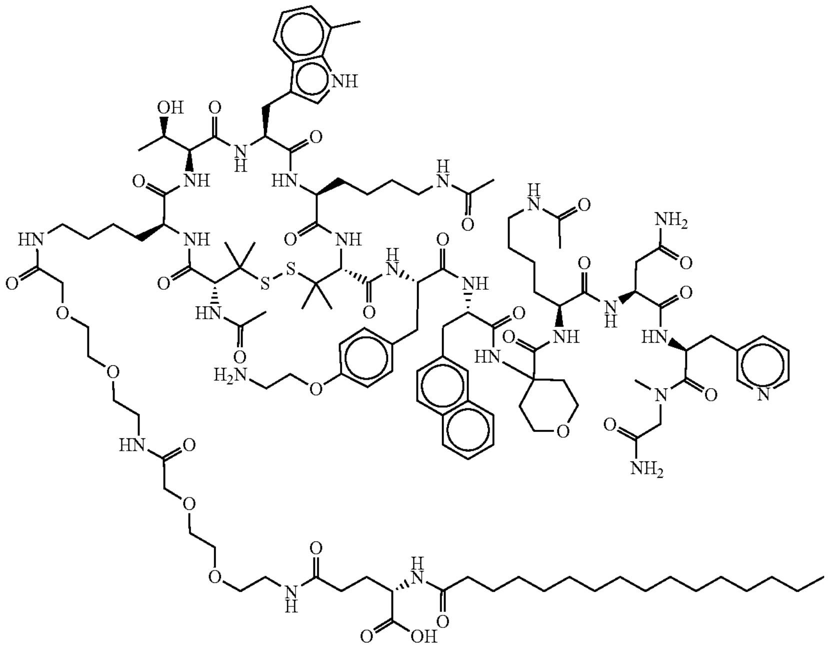<br>(Example 83) |

TABLE 1D-continued
| Compounds | |
|---|---|
| SEQ ID | Structure |
| 84 | 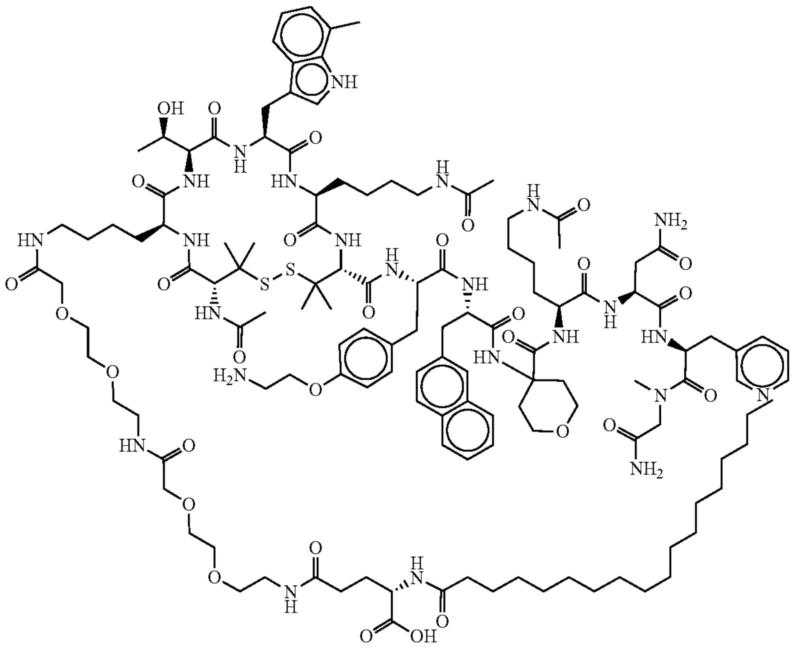 (Example 84) |
| 85 | 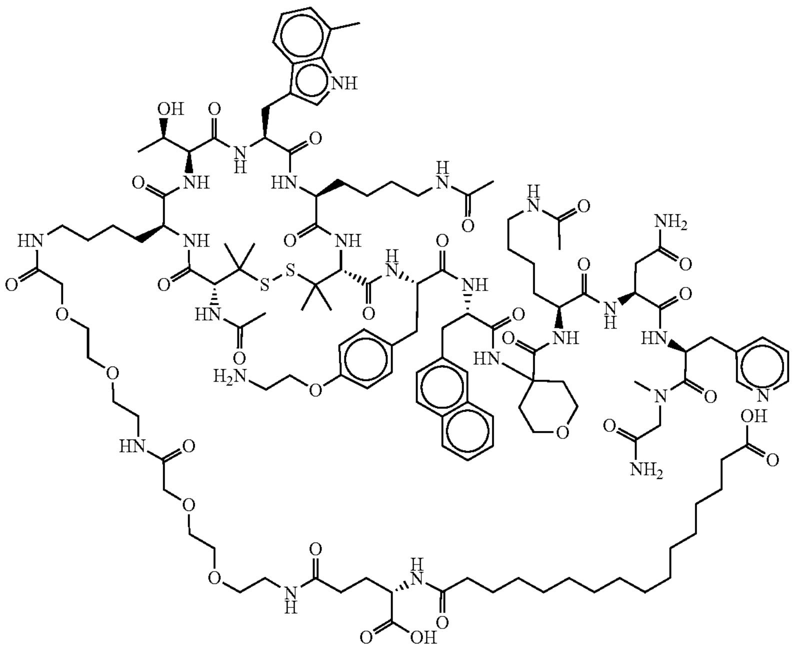 (Example 85) |

TABLE 1D-continued
| Compounds | |
|---|---|
| SEQ ID | Structure |
| 86 | 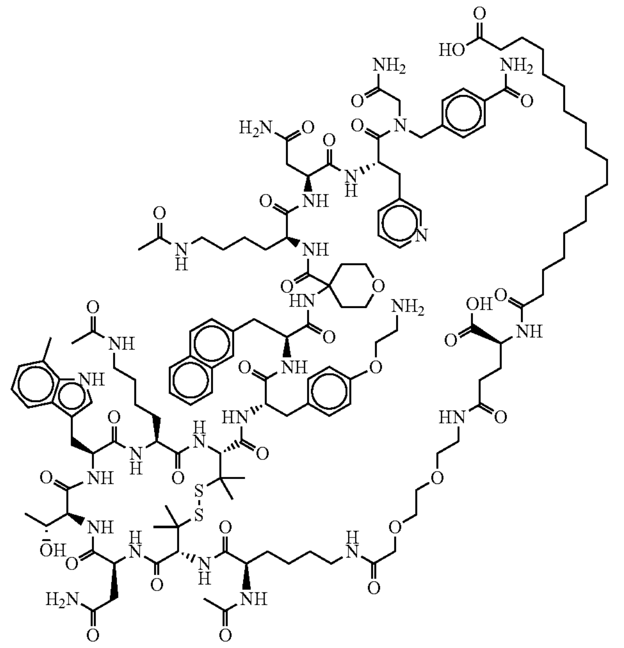 (Example 86) |
| 87 | 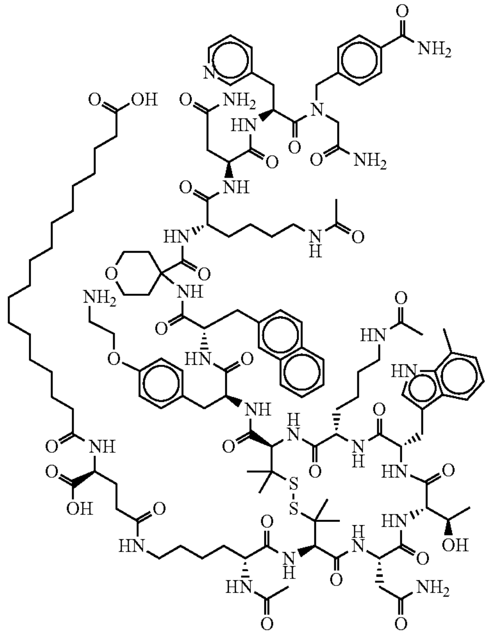 (Example 87) |

TABLE 1D-continued
| SEQ ID | Compounds Structure |
| --- | --- |
| 88 | 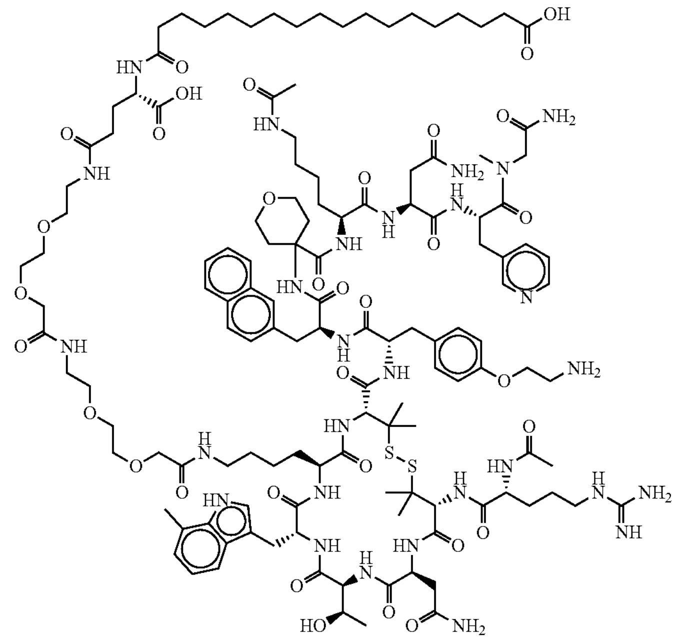 (Example 88) |
| 89 | 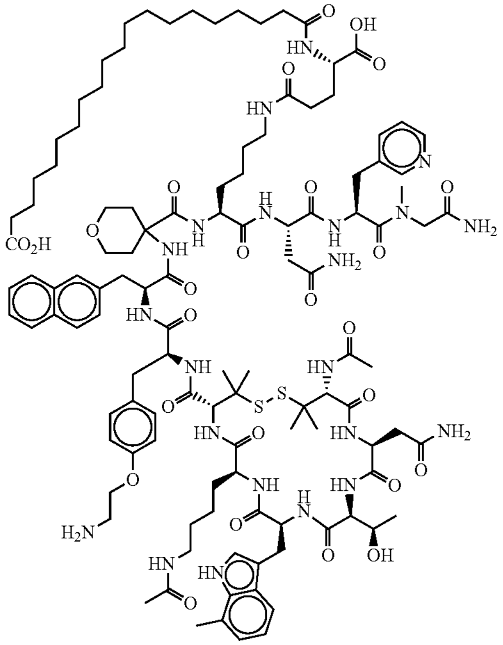 (Example 89) |

TABLE 1D-continued
| Compounds | |
|---|---|
| SEQ ID | Structure |
| 90 | 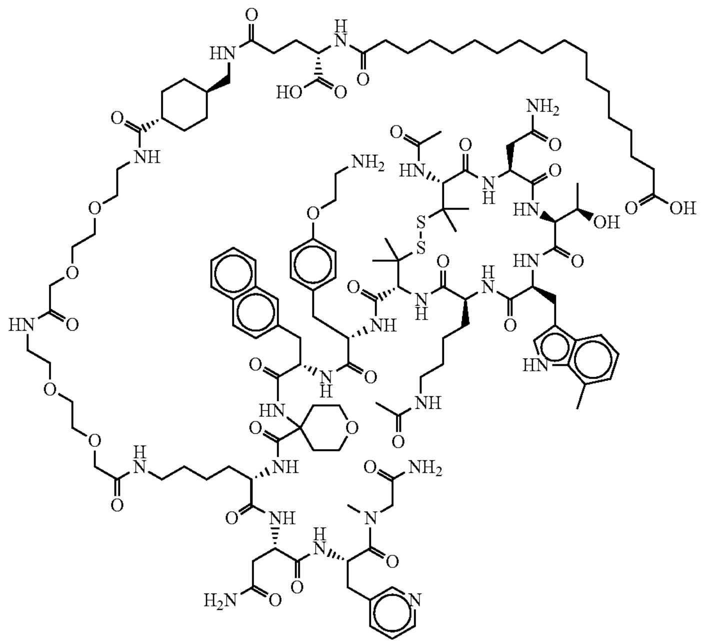 (Example 90) |
| 91 | 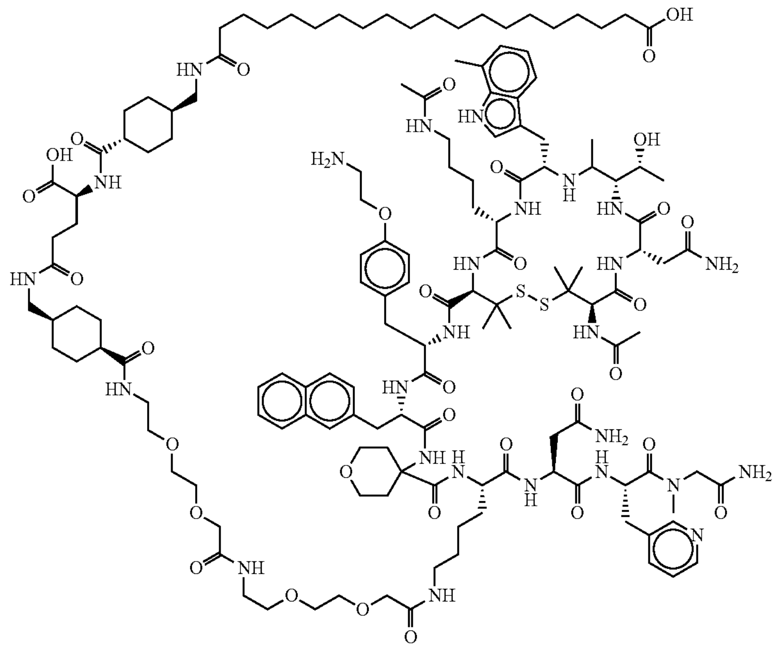 (Example 91) |

TABLE 1D-continued
| Compounds | |
|---|---|
| SEQ ID | Structure |
| 92 | 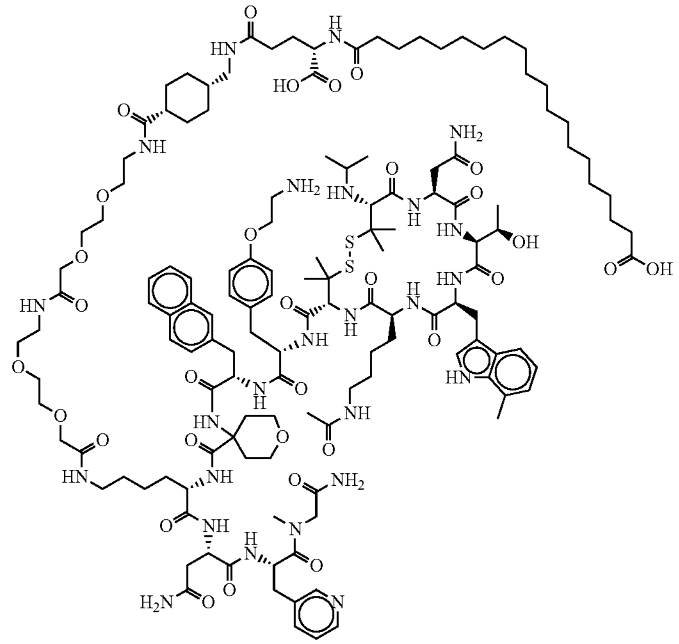 (Example 92) |
| 93 | 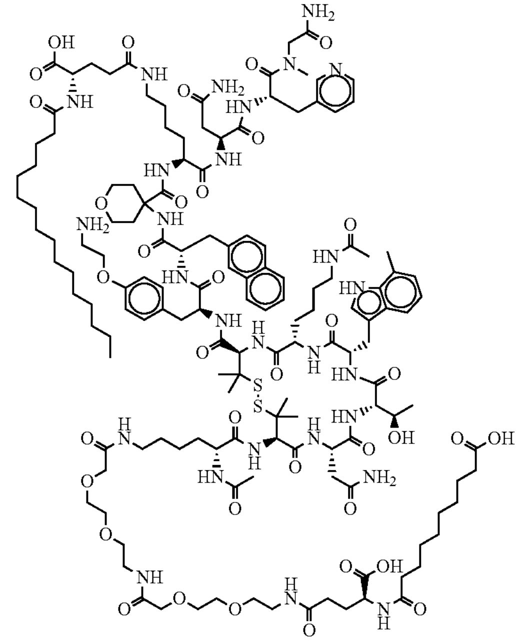 (Example 93) |

TABLE 1D-continued
| Compounds | |
|---|---|
| SEQ ID | Structure |
| 94 | 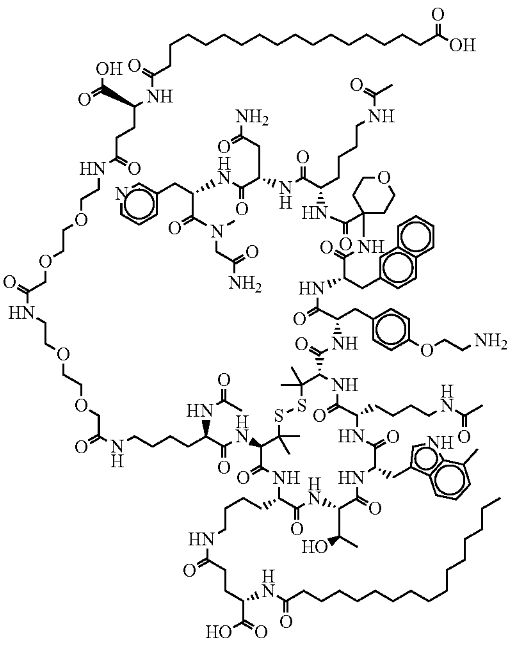 (Example 94) |
| 95 | 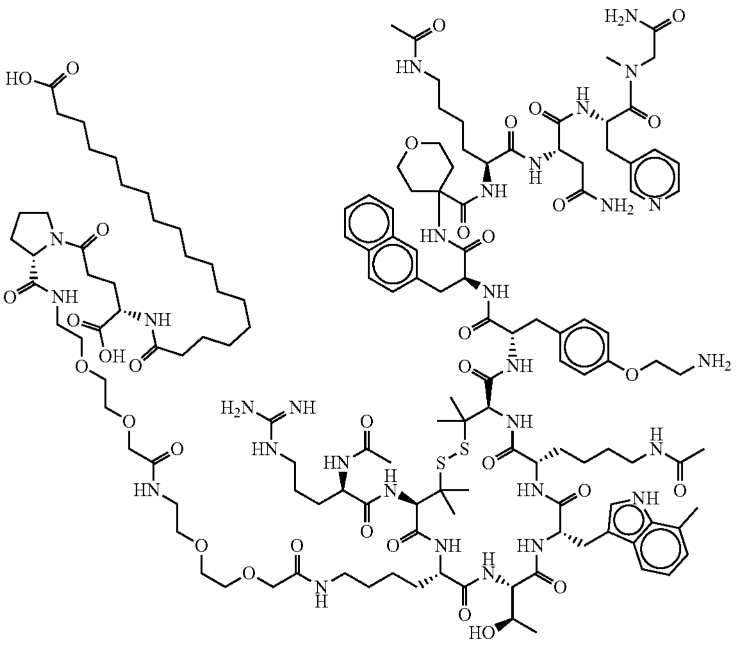 (Example 95) |

TABLE 1D-continued
| Compounds | |
|---|---|
| SEQ ID | Structure |
| 96 | 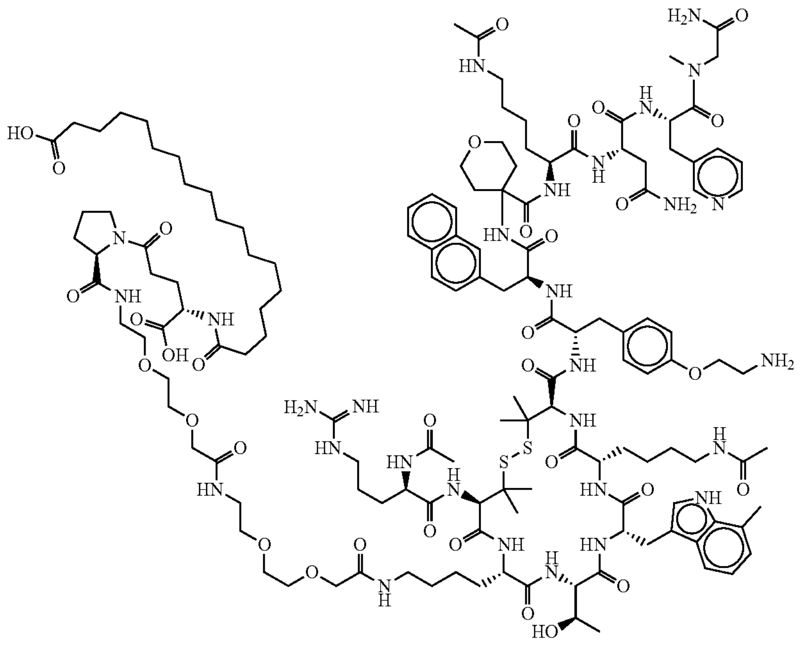 (Example 96) |
| 97 | 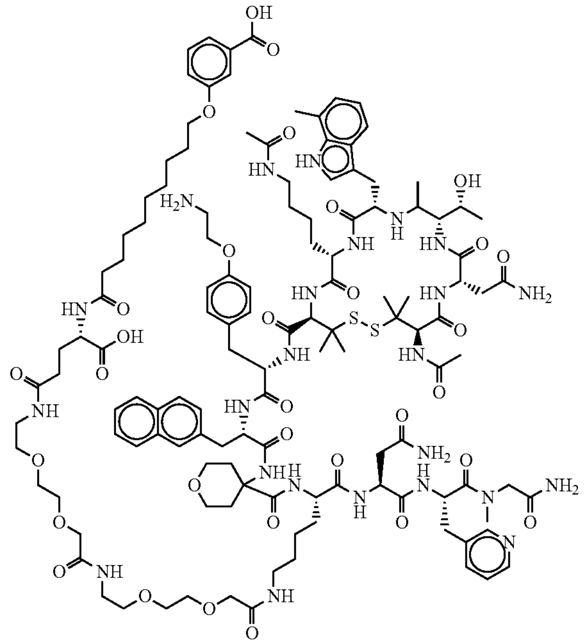 (Example 97) |

TABLE 1D-continued
| Compounds | |
|---|---|
| SEQ ID | Structure |
| 98 | 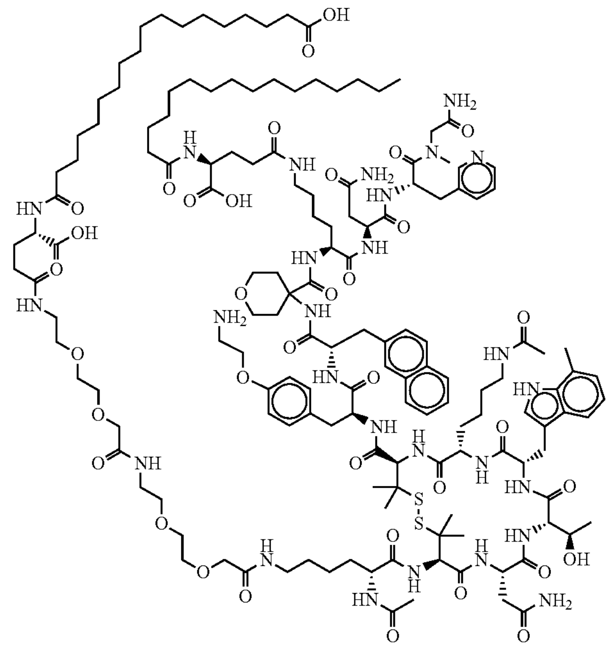 (Example 98) |
| 99 | 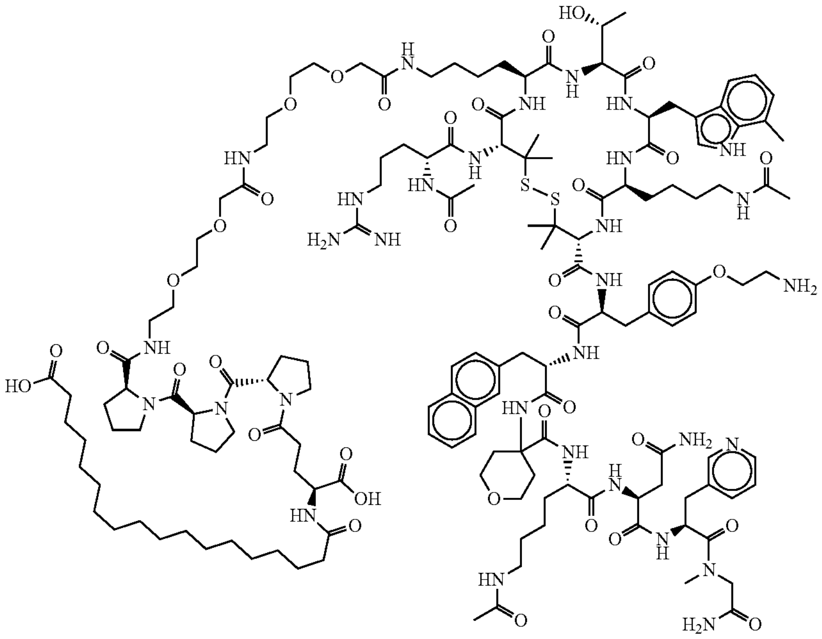 (Example 99) |

TABLE 1D-continued
| Compounds | |
|---|---|
| SEQ ID | Structure |
| 100 | 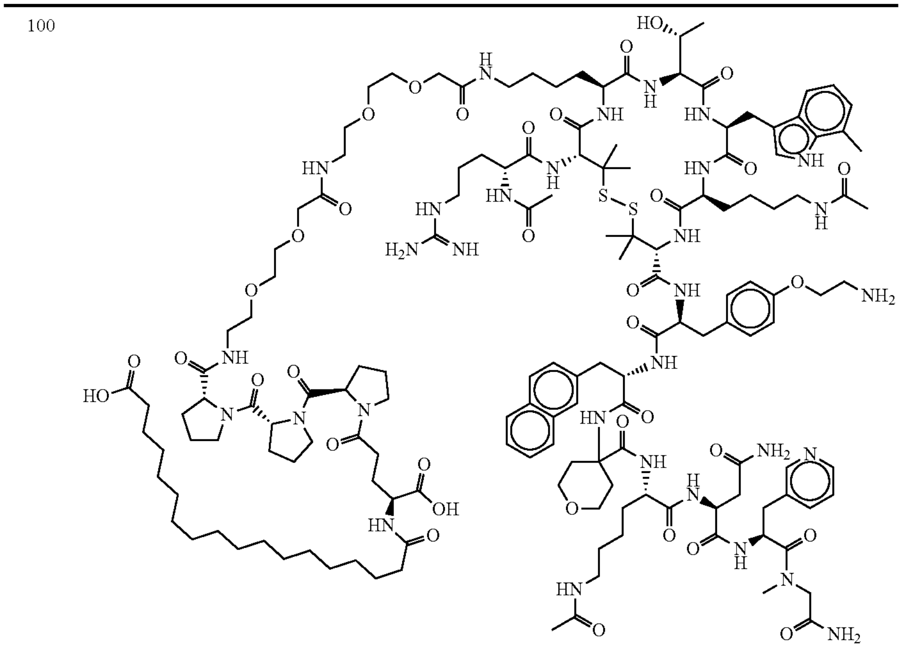 (Example 100) |

TABLE 1E
| Compounds | | |
|---|---|---|
| SEQ ID | Structure | |
| 101 | 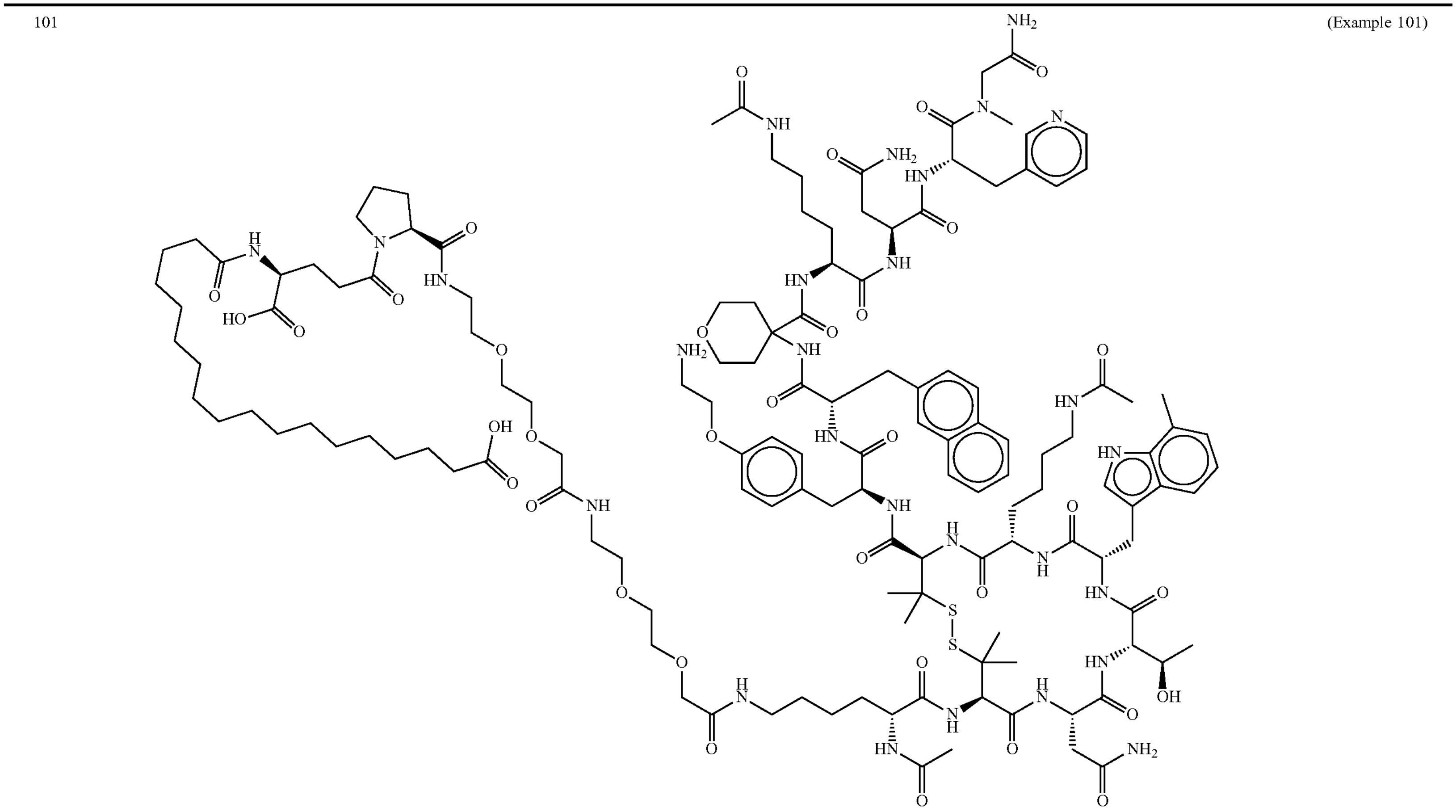 | (Example 101) |

TABLE 1E-continued
| Compounds | | |
|---|---|---|
| SEQ ID | Structure | |
| 102 | 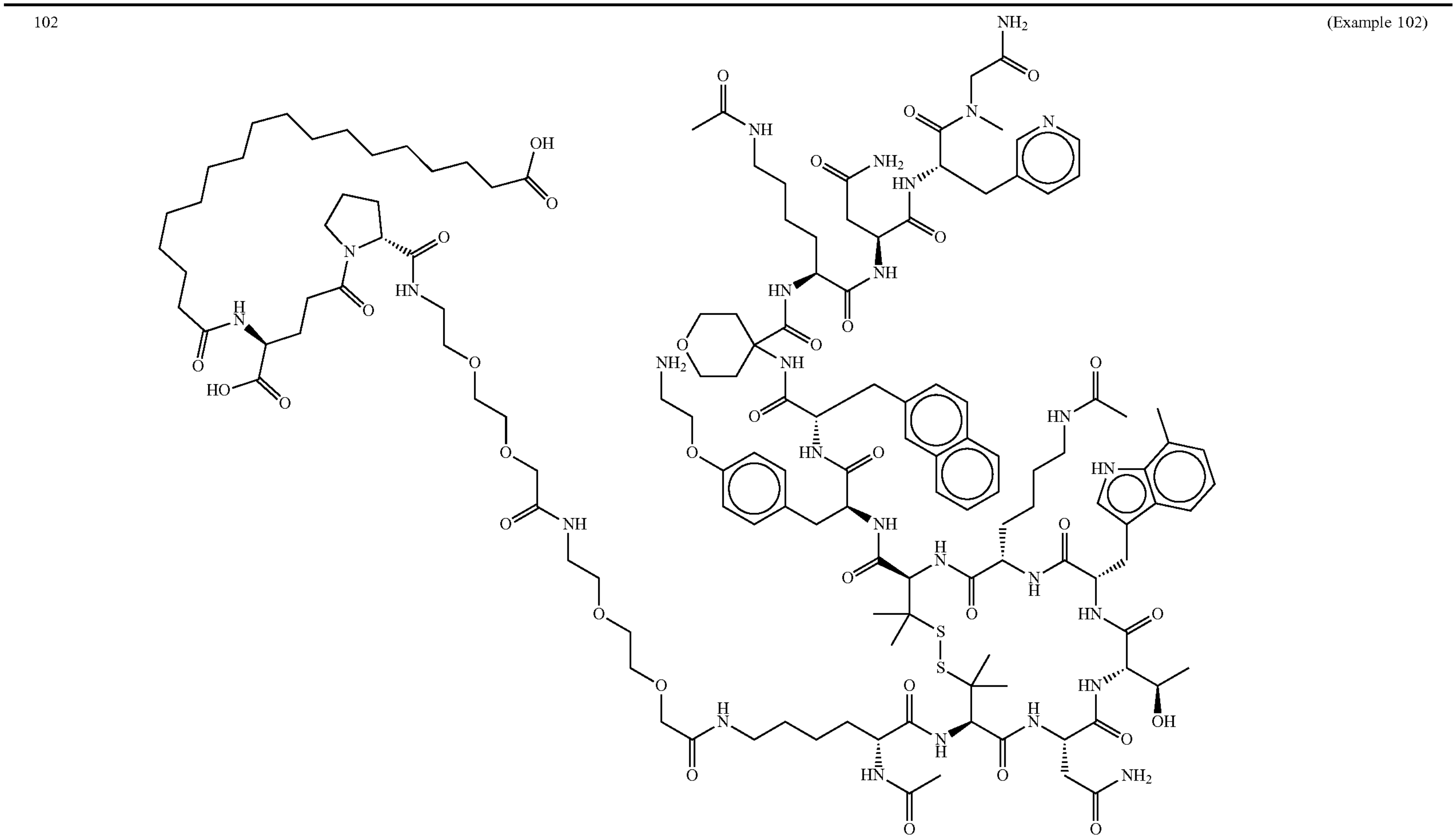 | (Example 102) |

TABLE 1E-continued
| Compounds | | |
|---|---|---|
| SEQ ID | Structure | |
| 103 | 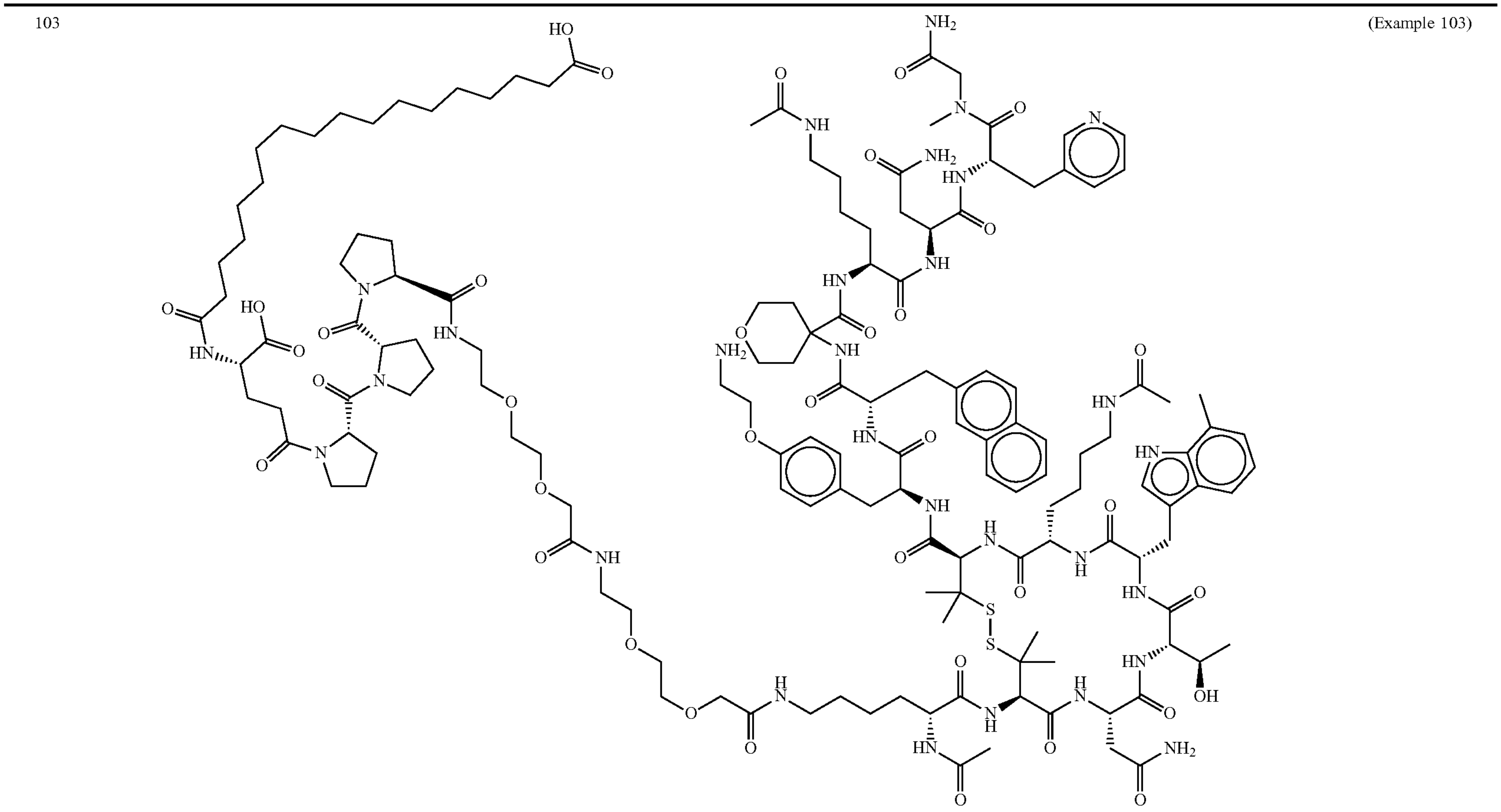 | (Example 103) |

TABLE 1E-continued
| Compounds | |
|---|---|
| SEQ ID | Structure |
| 104 | 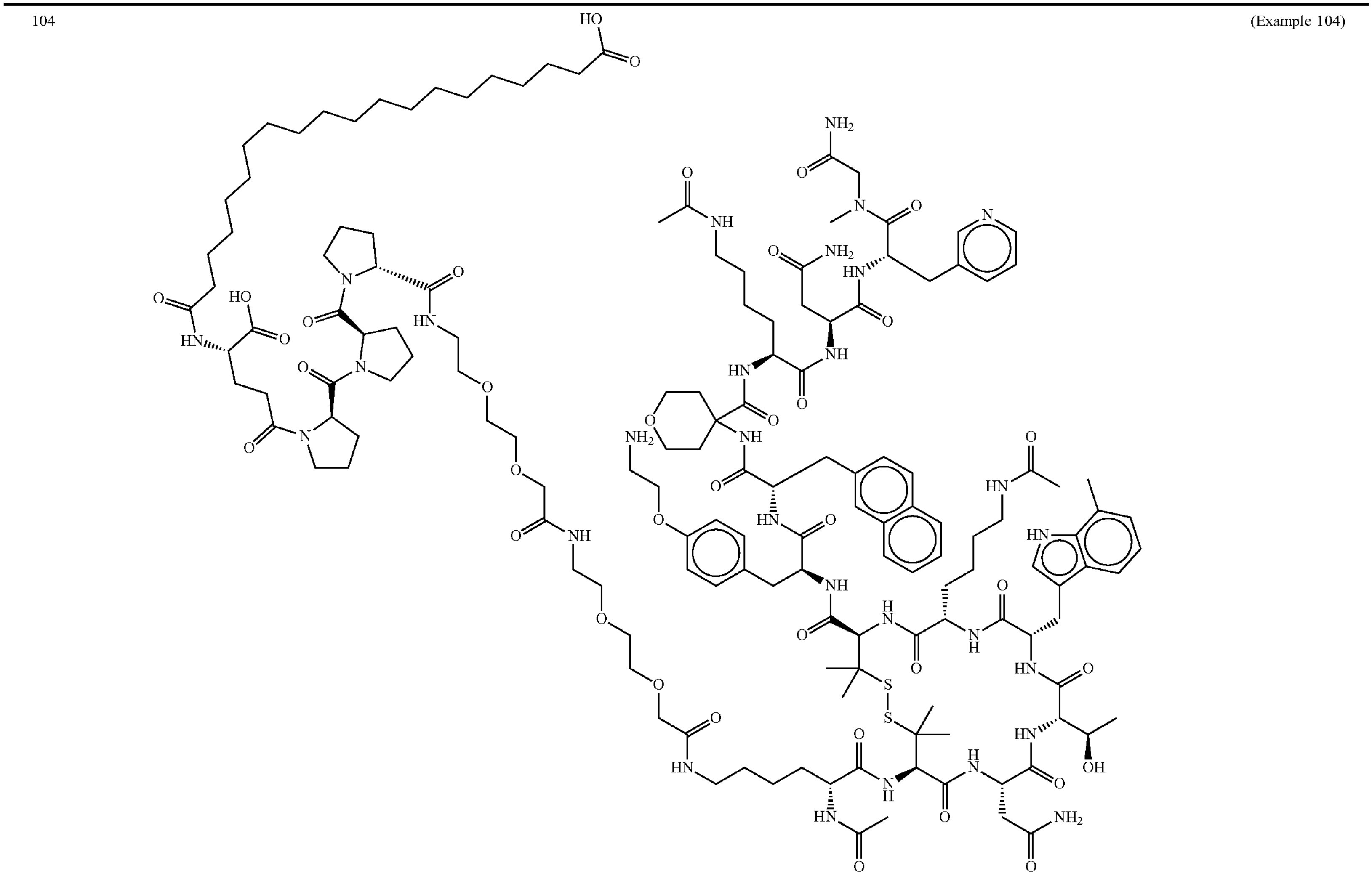 (Example 104) |

TABLE 1E-continued
| Compounds | | |
|---|---|---|
| SEQ ID | Structure | |
| 105 | 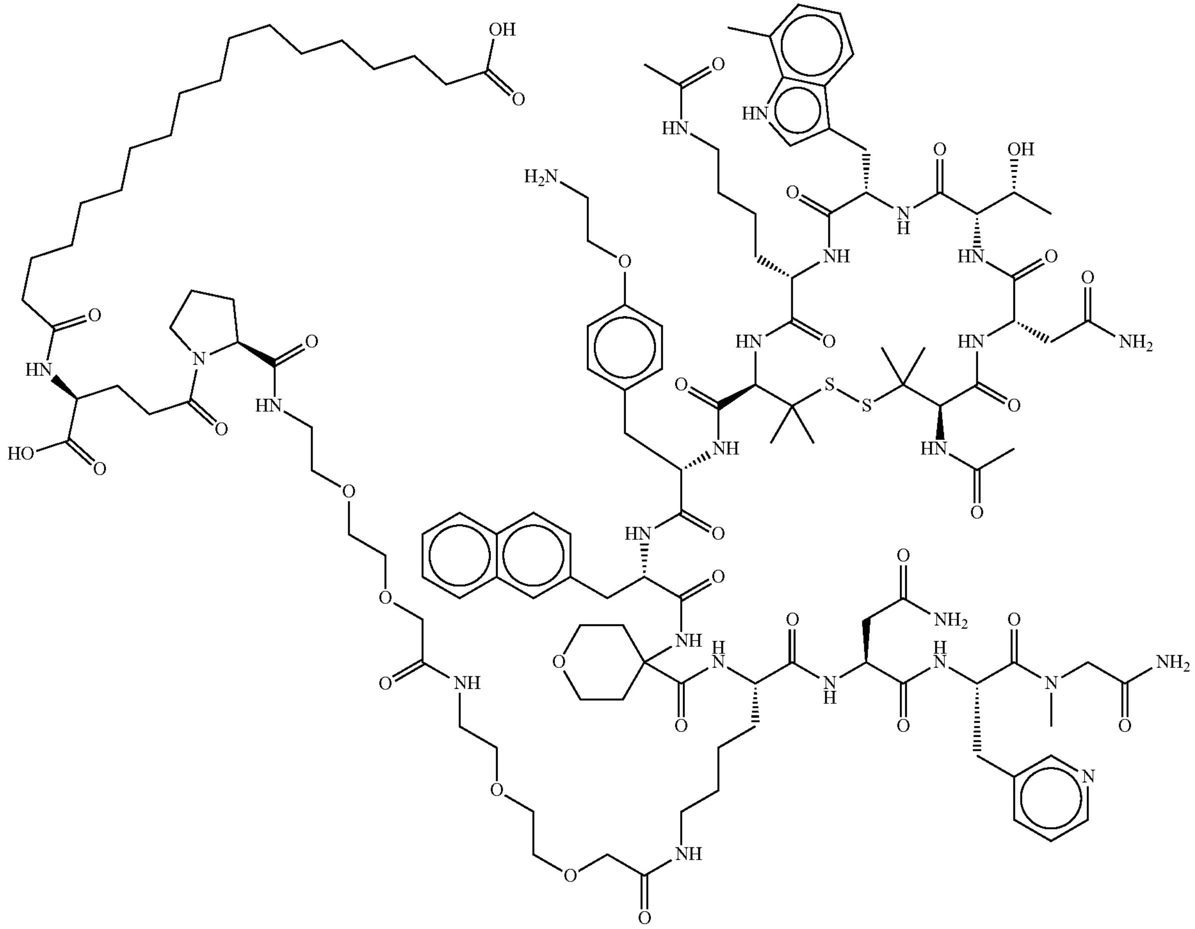 | (Example 105) |

TABLE 1E-continued
| Compounds | | |
|---|---|---|
| SEQ ID | Structure | |
| 106 | 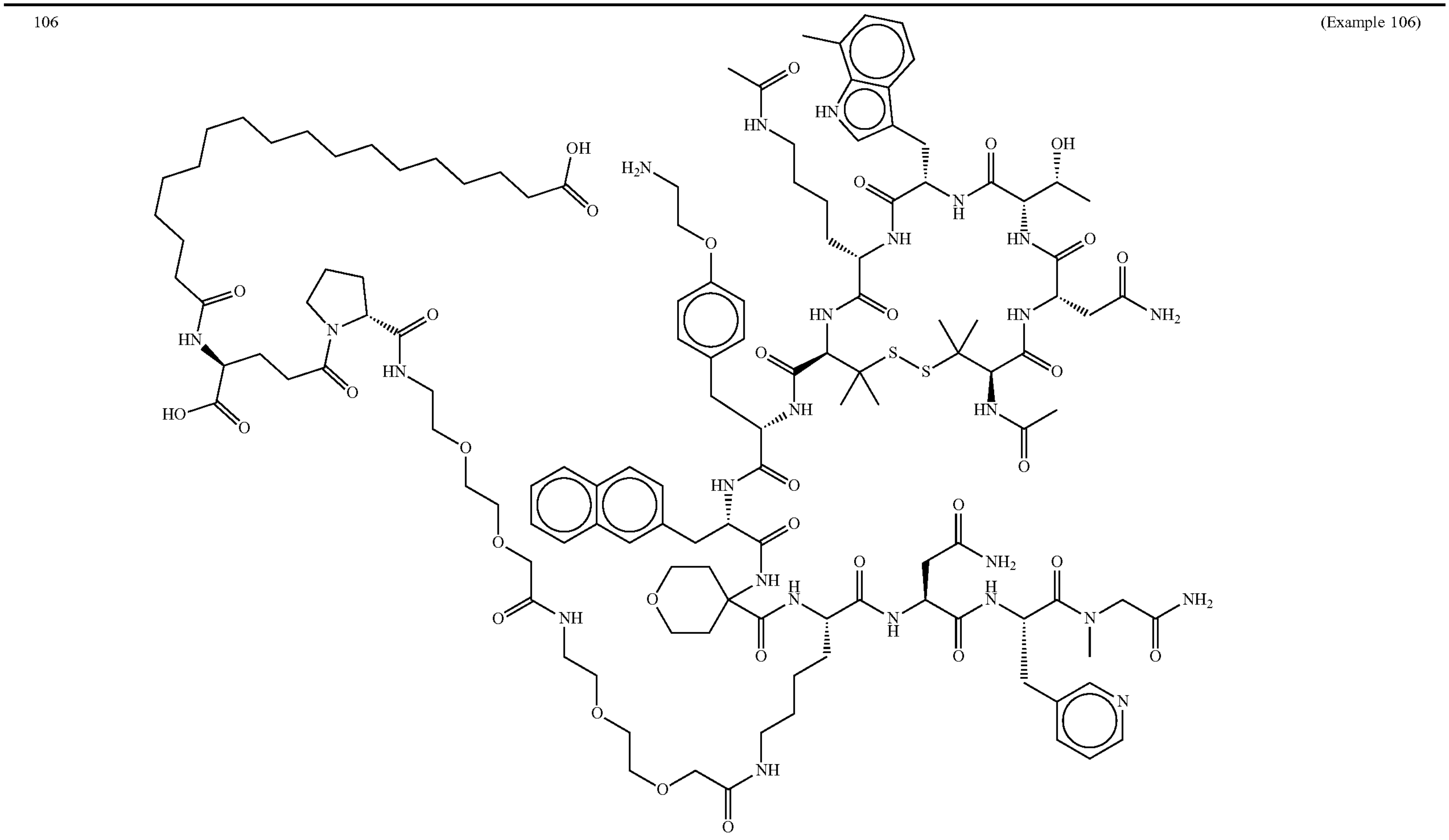 | (Example 106) |

TABLE 1E-continued
| Compounds | | |
|---|---|---|
| SEQ ID | Structure | |
| 107 | 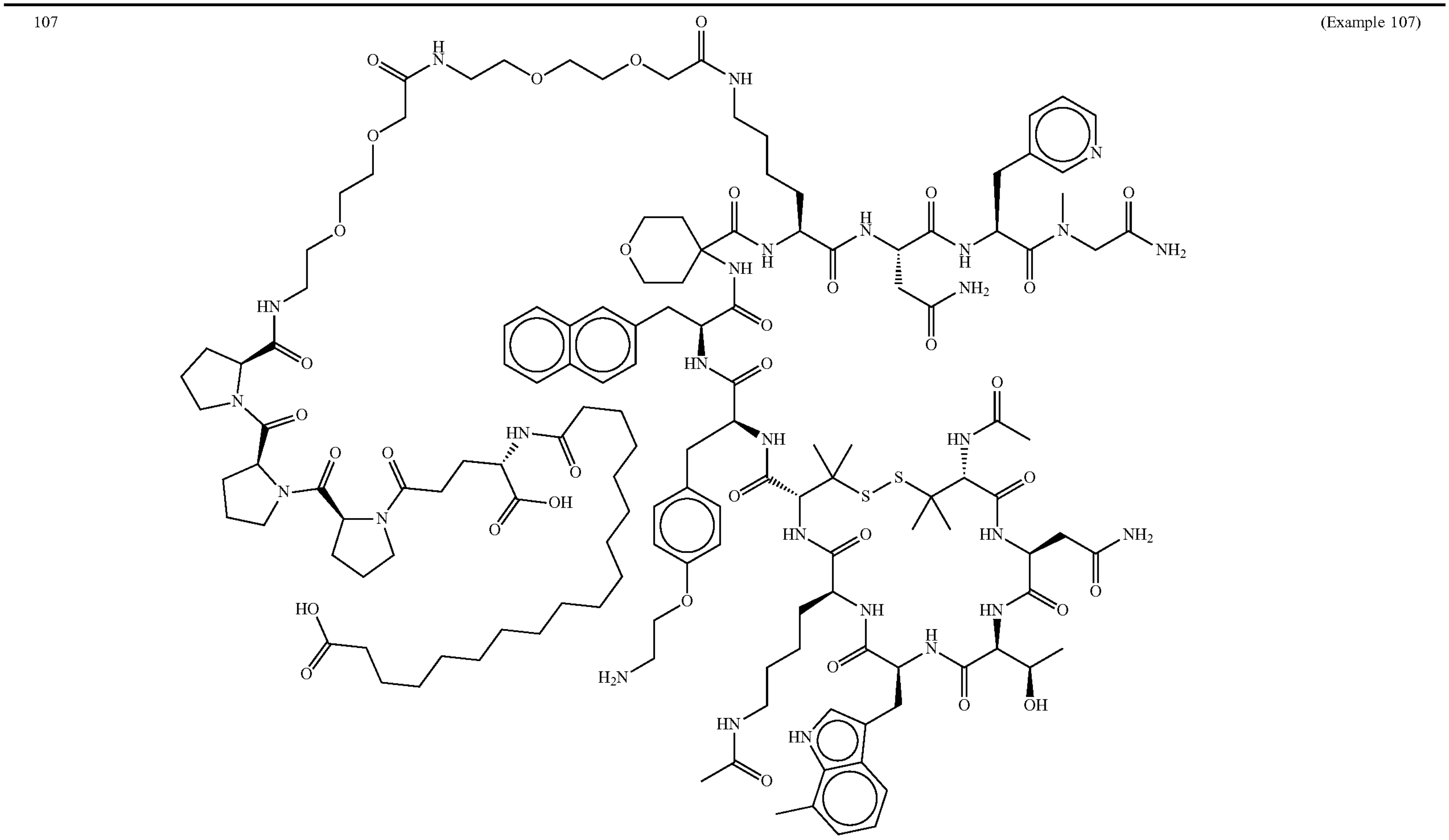 | (Example 107) |

TABLE 1E-continued
| Compounds | | |
|---|---|---|
| SEQ ID | Structure | |
| 108 | 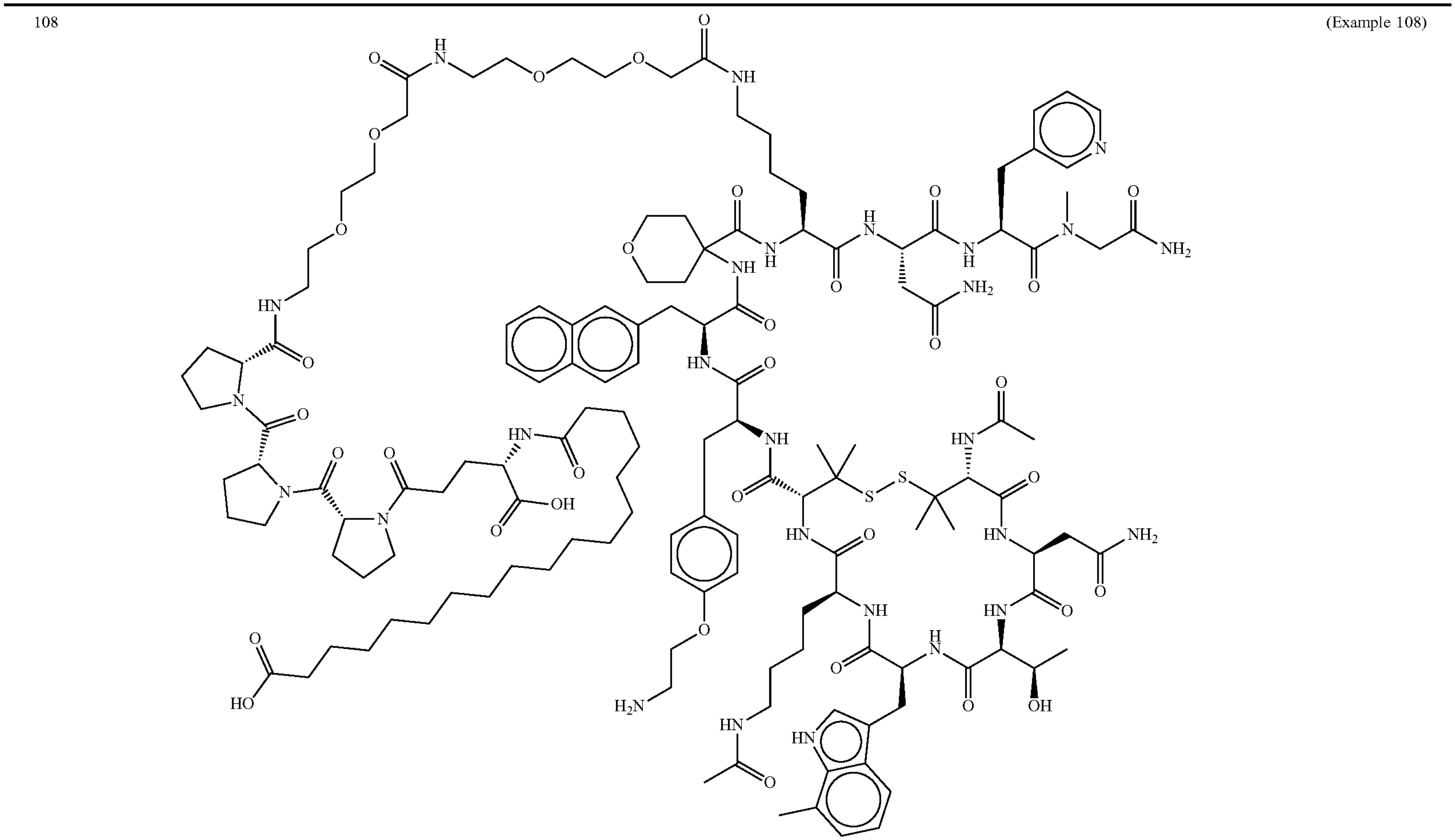 | (Example 108) |

TABLE 1E-continued
| SEQ ID | Compounds<br>Structure | |
|---|---|---|
| 109 | 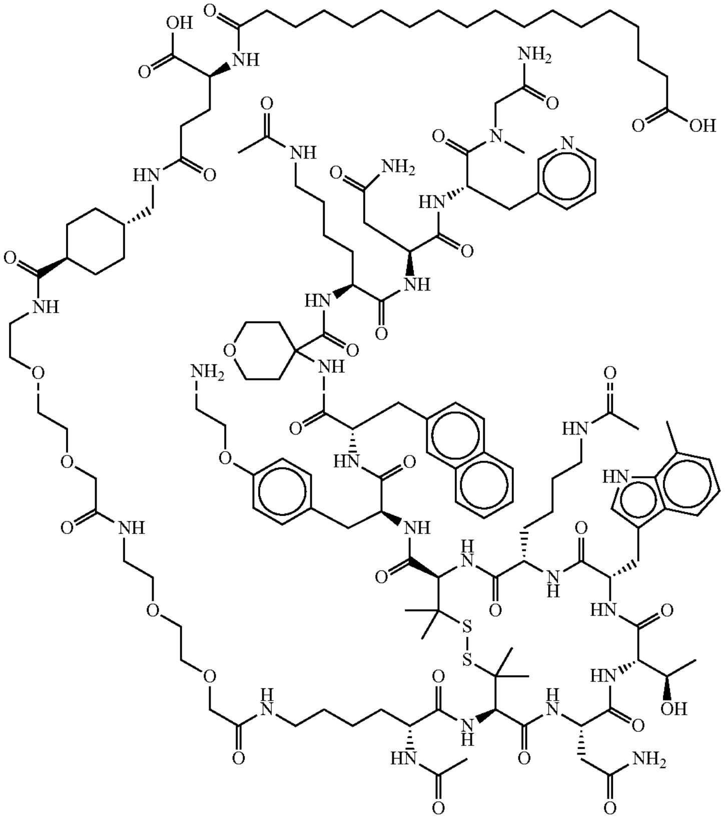 | (Example 109) |

TABLE 1E-continued
| Compounds | | |
|---|---|---|
| SEQ ID | Structure | |
| 110 | 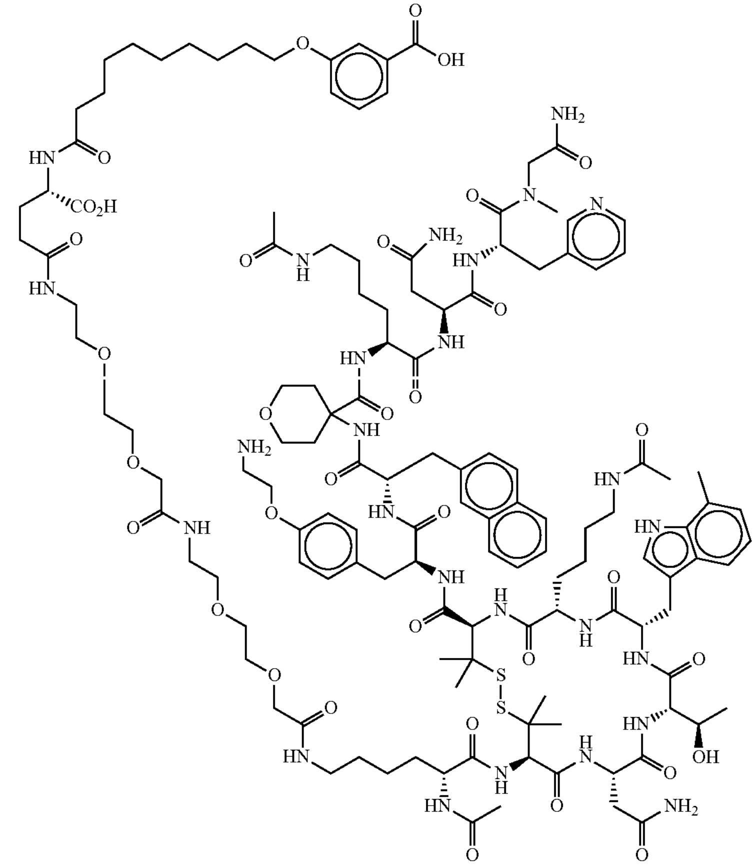 | (Example 110) |

TABLE 1E-continued
| Compounds | | |
|---|---|---|
| SEQ ID | Structure | |
| 111 | 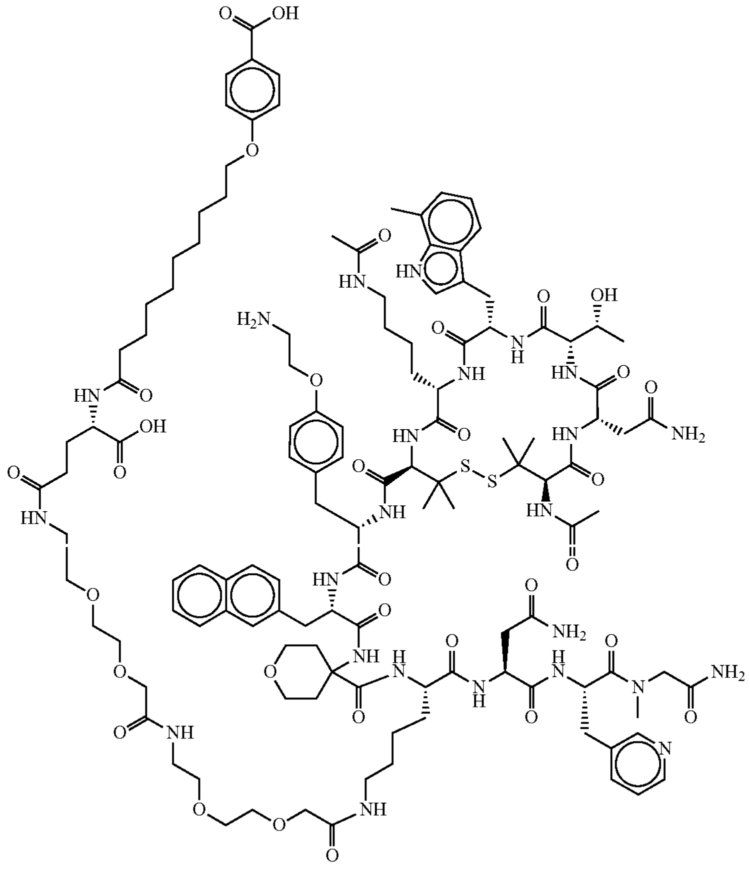 | (Example 111) |

TABLE 1E-continued
| Compounds | | |
|---|---|---|
| SEQ ID | Structure | |
| 112 | 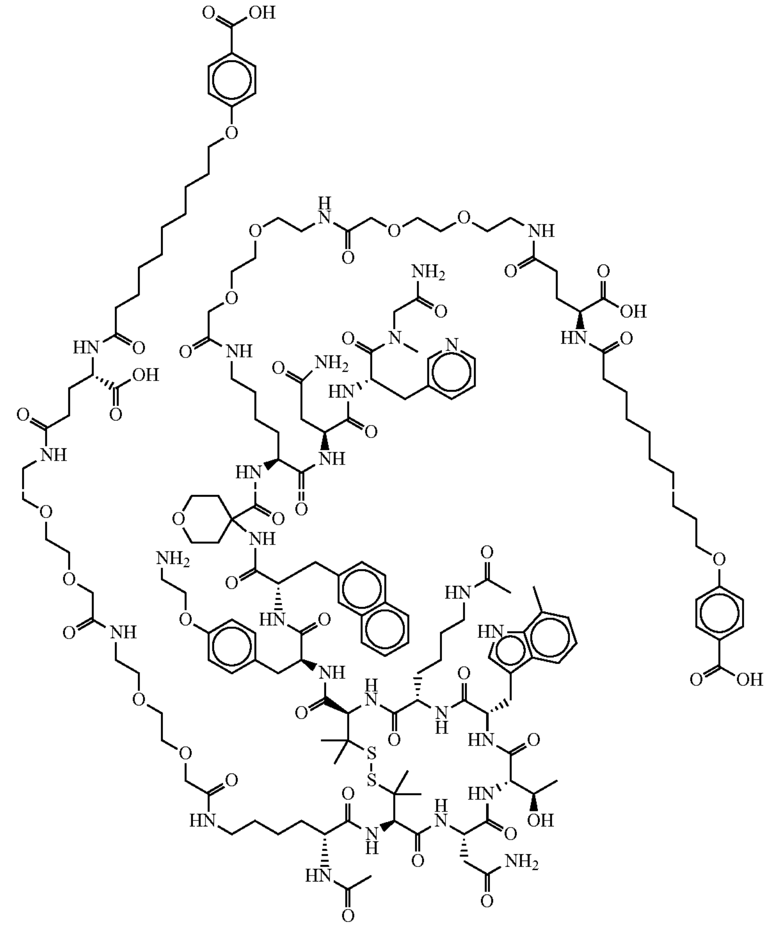 | (Example 112) |

TABLE 1E-continued
| SEQ ID | Compounds<br>Structure | |
|---|---|---|
| 113 | 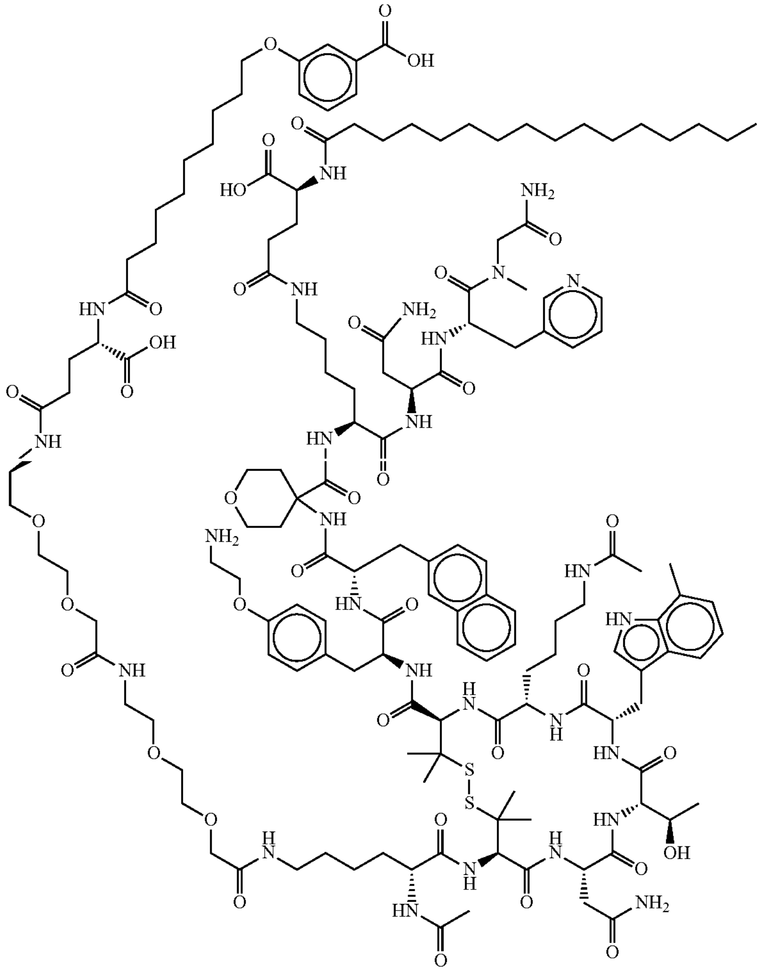 | (Example 113) |

TABLE 1E-continued
| Compounds | | |
|---|---|---|
| SEQ ID | Structure | |
| 114 | 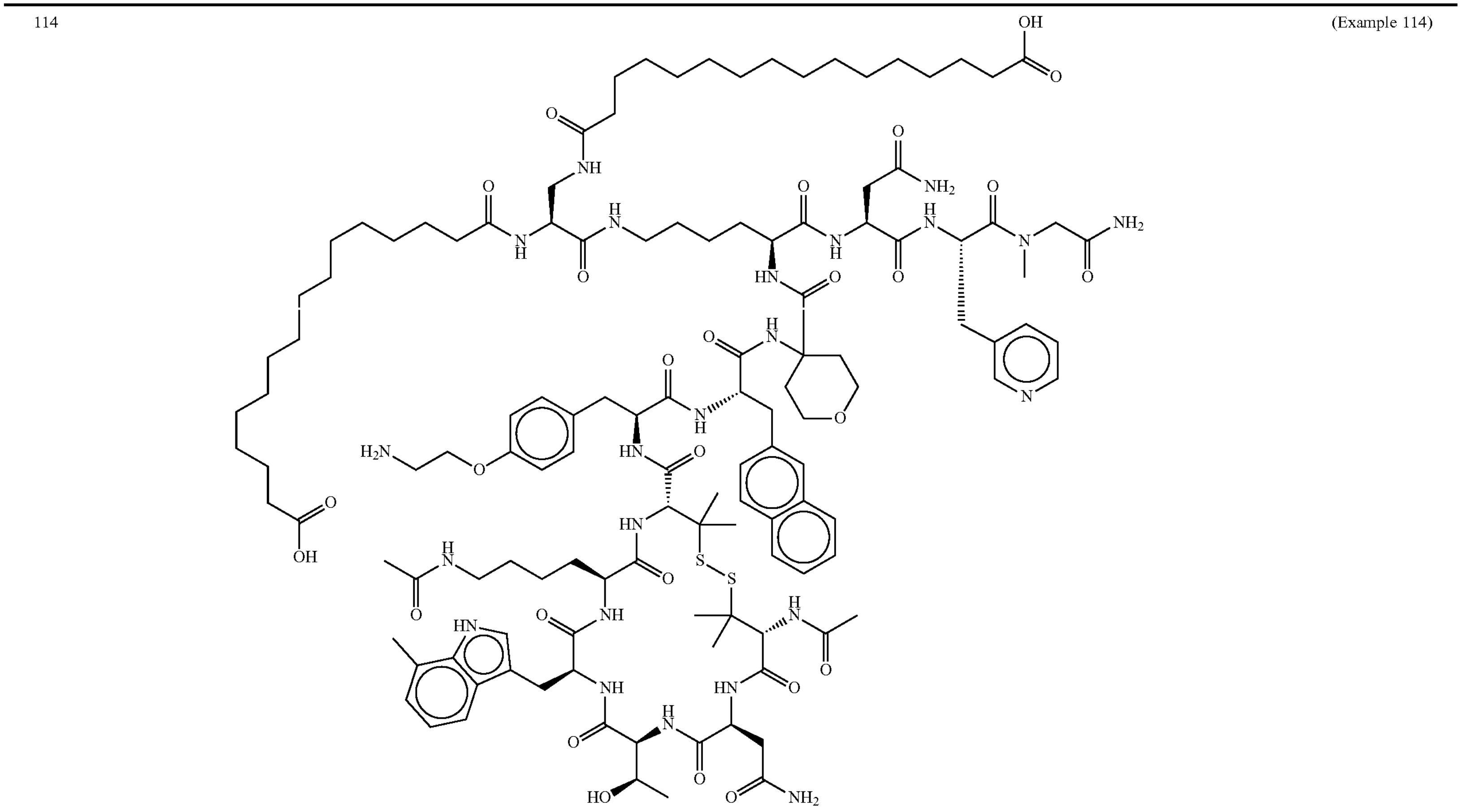 | (Example 114) |

TABLE 1E-continued
| Compounds | | |
| --- | --- | --- |
| SEQ ID | Structure | |
| 115 | 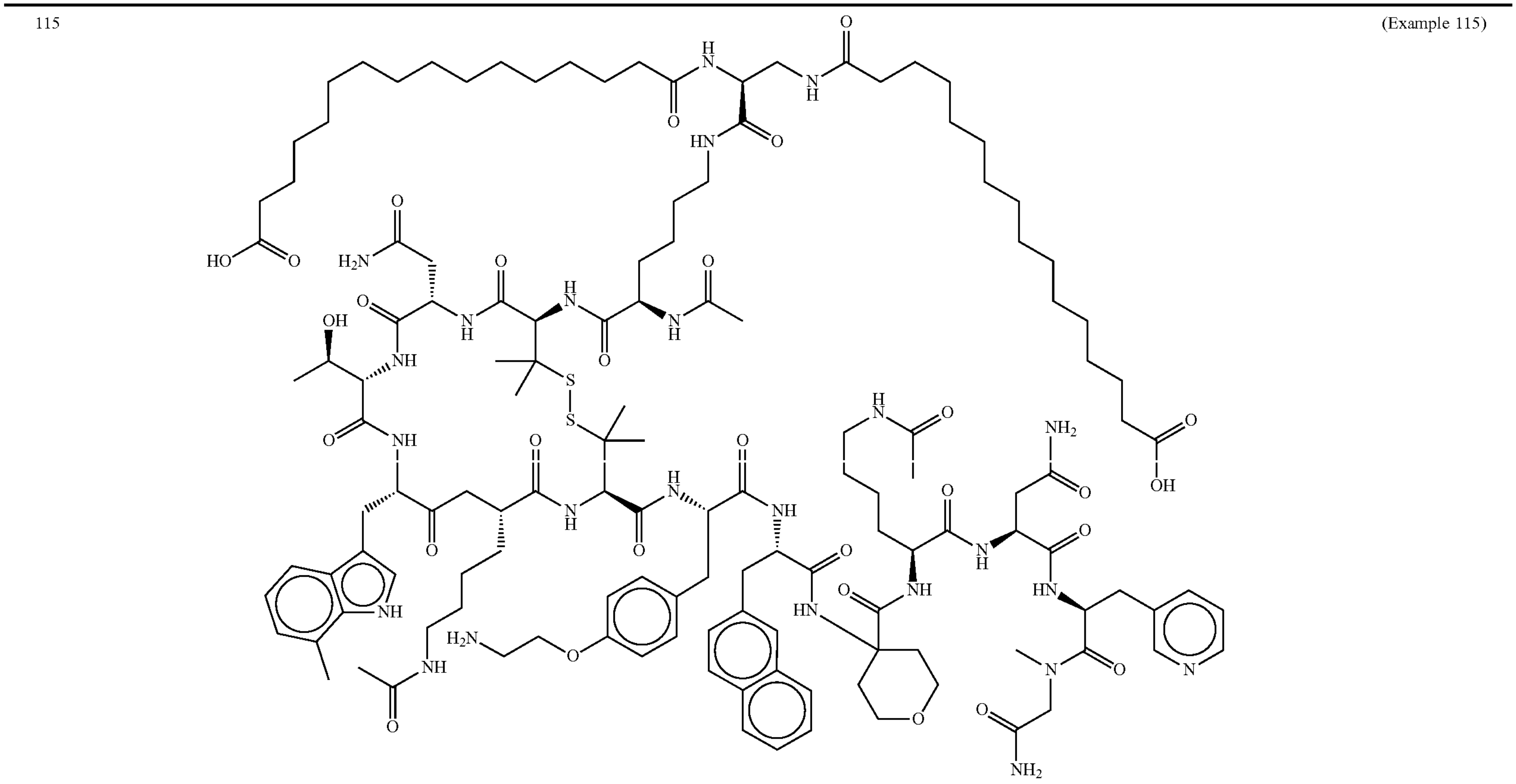 | (Example 115) |

TABLE 1E-continued
| Compounds | | |
|---|---|---|
| SEQ ID | Structure | |
| 116 | 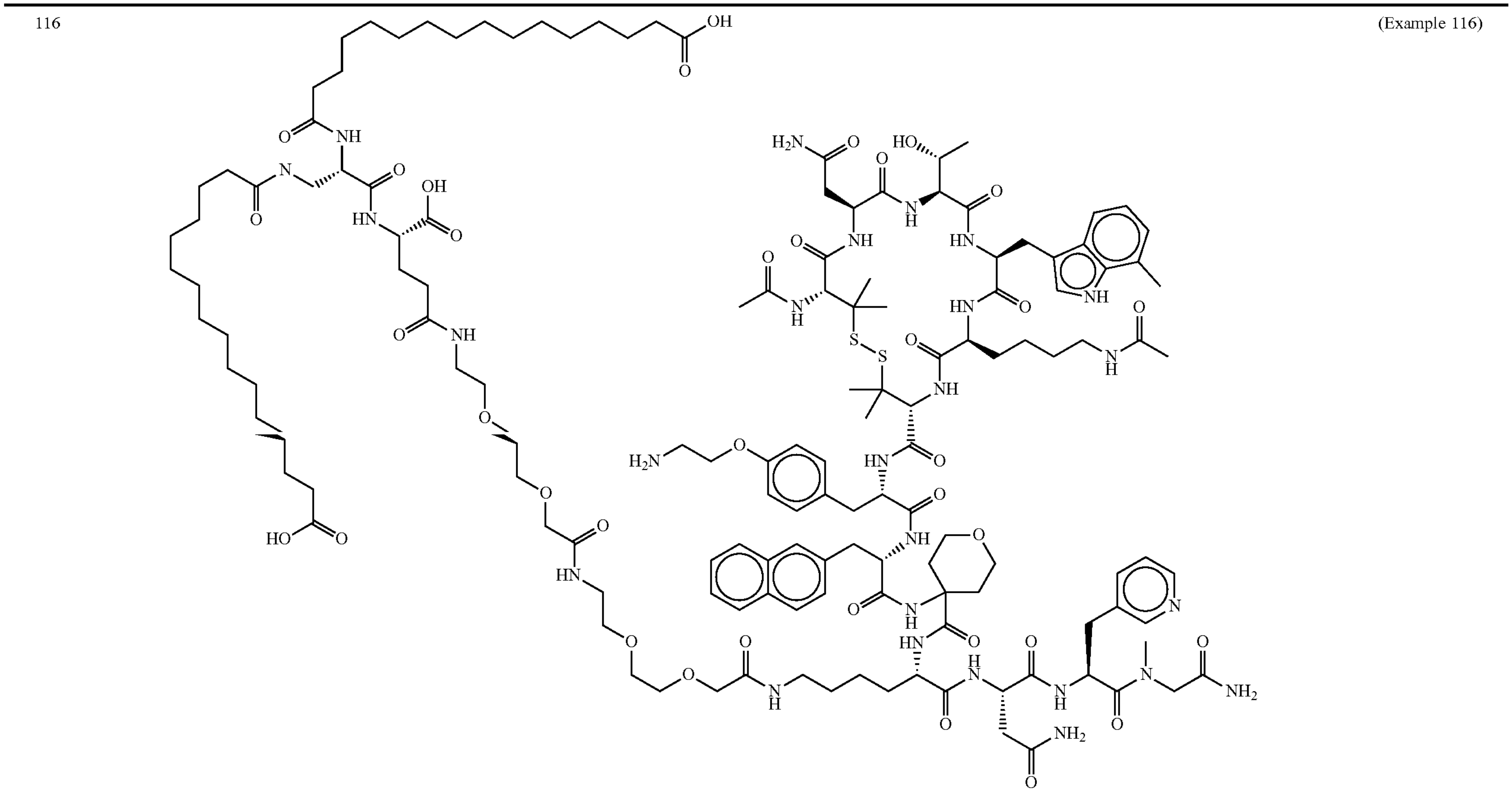 | (Example 116) |

TABLE 1E-continued
| Compounds | | |
|---|---|---|
| SEQ ID | Structure | |
| 117 | 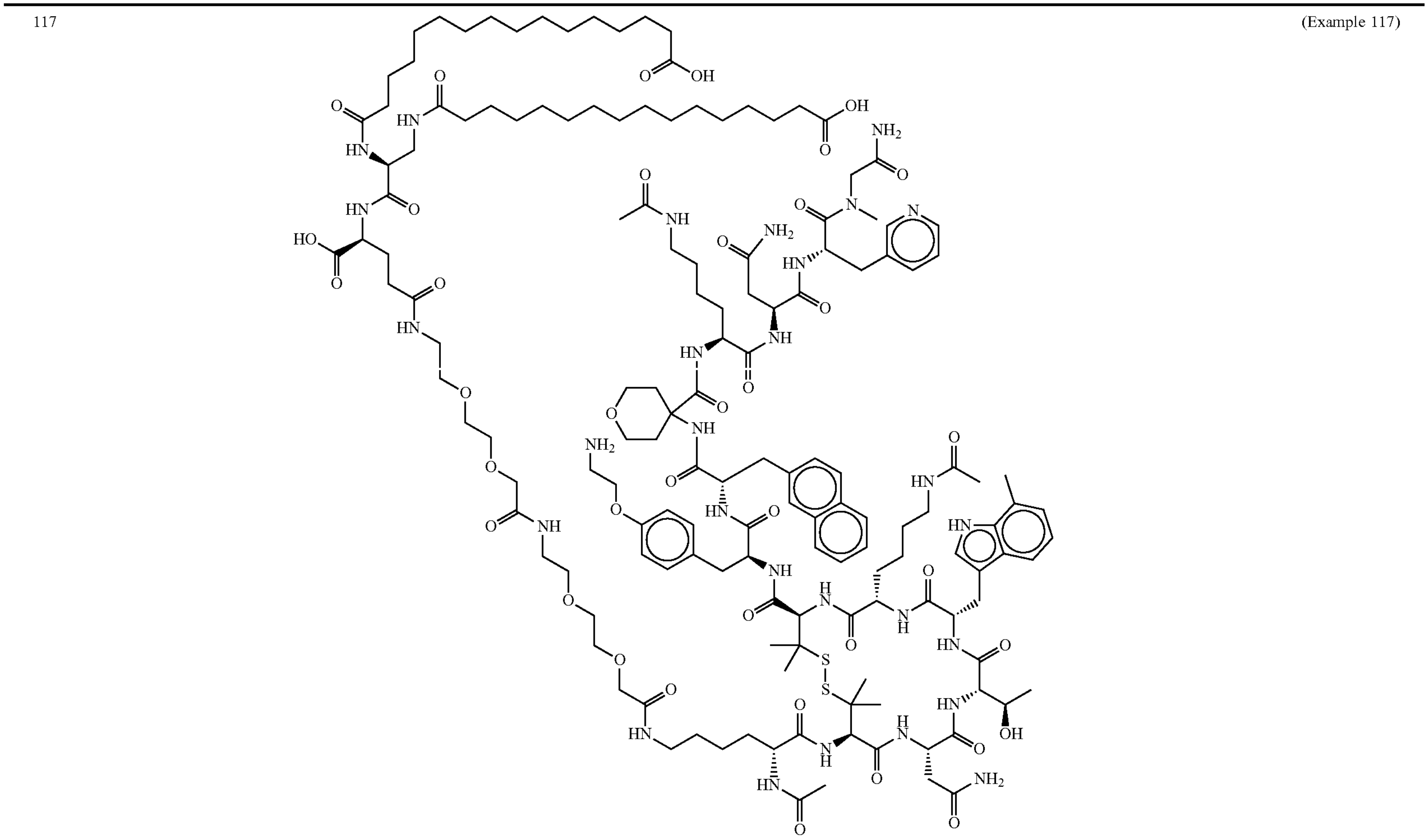 | (Example 117) |

TABLE 1E-continued
| SEQ ID | Compounds<br>Structure | |
|---|---|---|
| 118 | 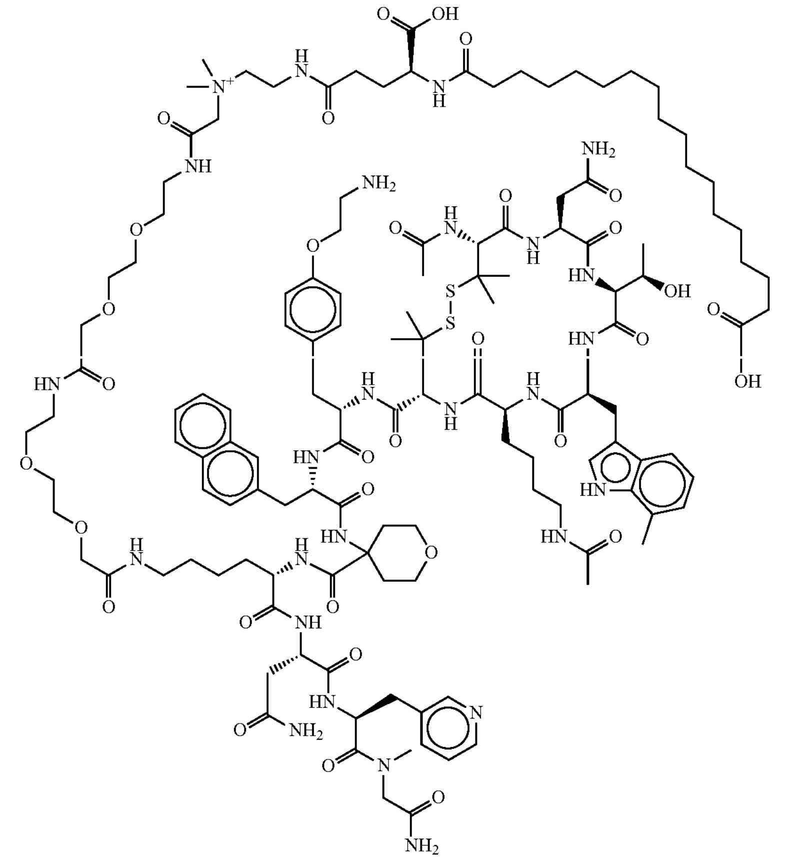 | (Example 118) |

TABLE 1E-continued
| Compounds | | |
|---|---|---|
| SEQ ID | Structure | |
| 119 | 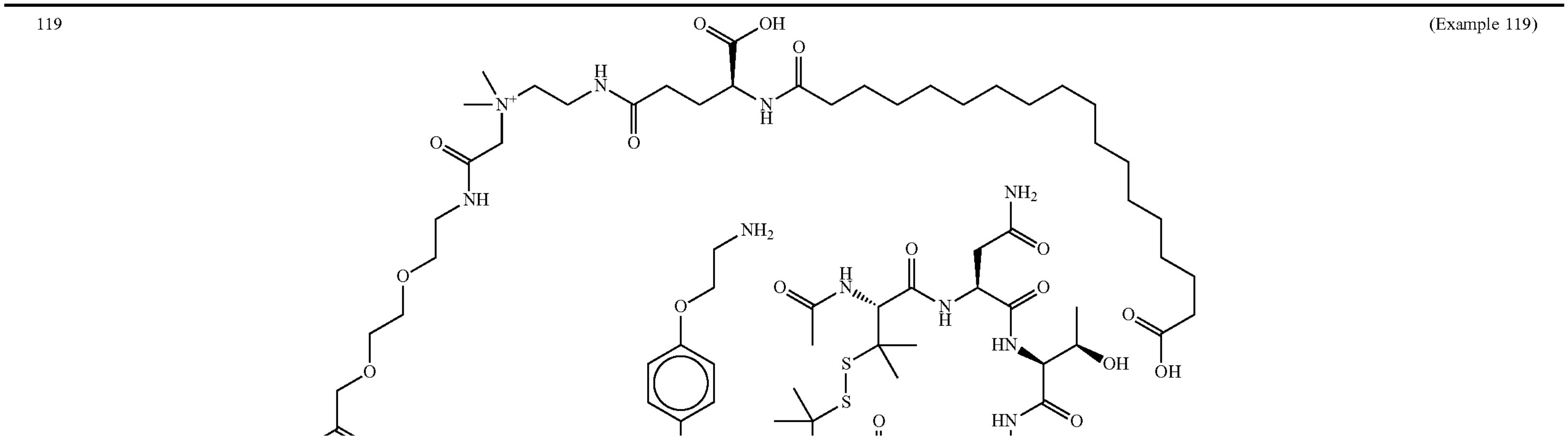 | (Example 119) |

TABLE 1E-continued
| Compounds | |
|---|---|
| SEQ ID | Structure |
| | 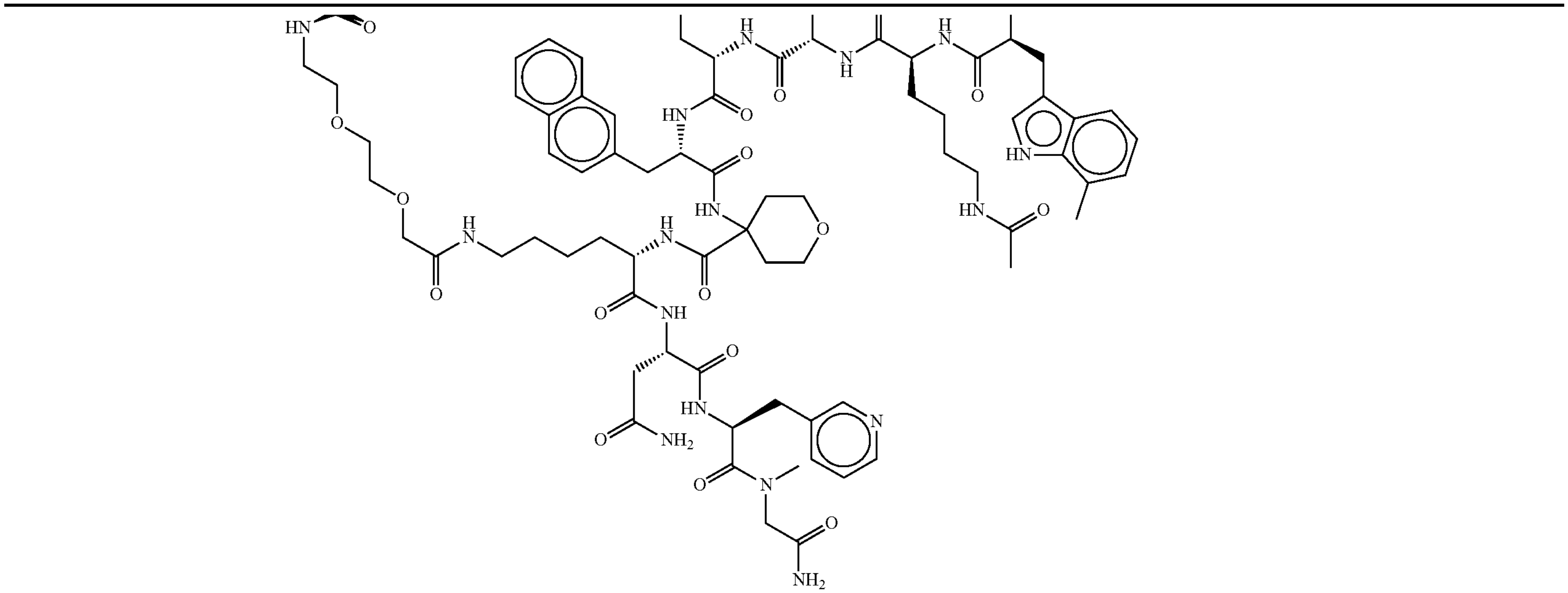 |

TABLE 1E-continued
| Compounds | | |
|---|---|---|
| SEQ ID | Structure | |
| 120 | 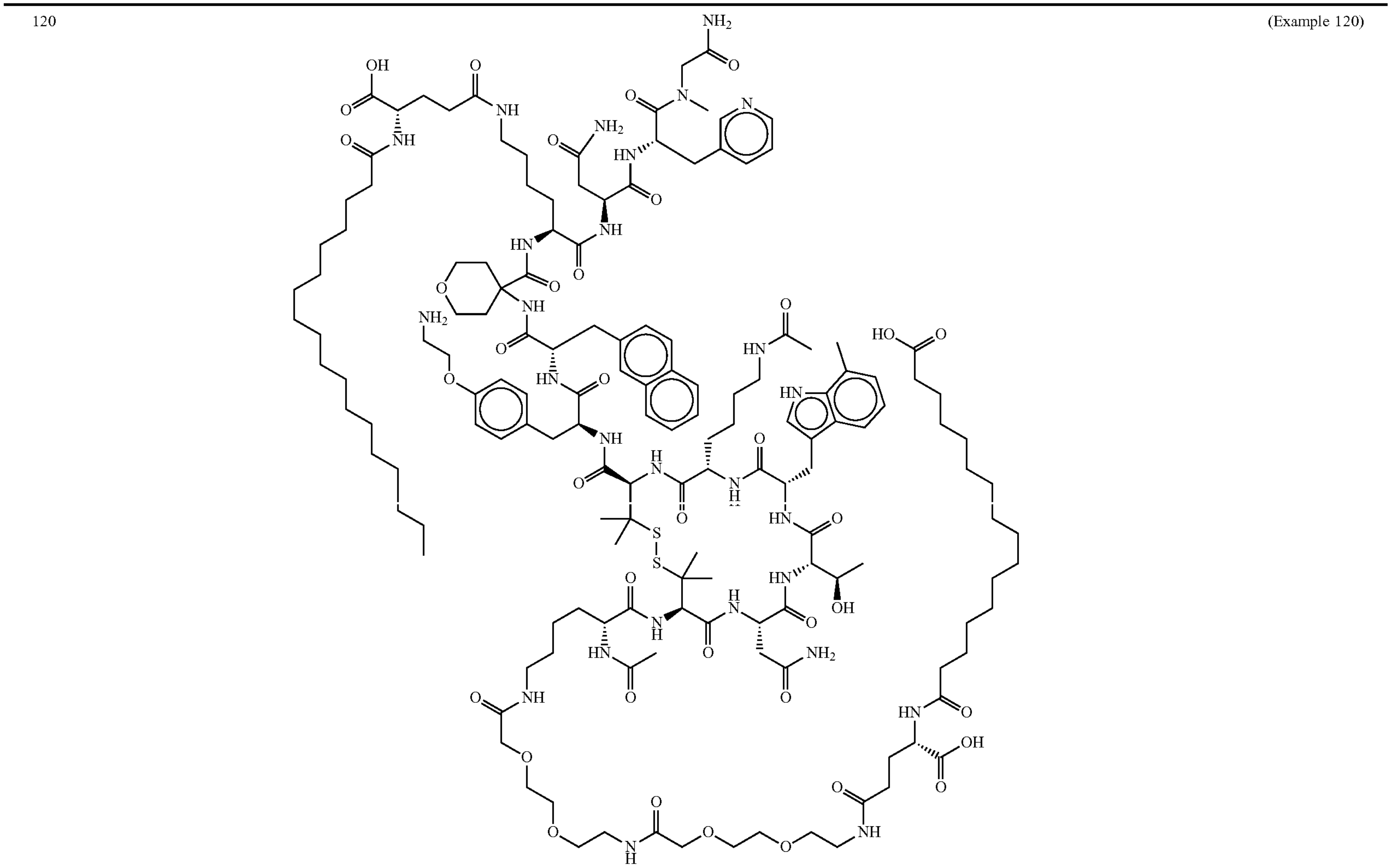 | (Example 120) |

TABLE 1E-continued
| Compounds | | |
|---|---|---|
| SEQ ID | Structure | |
| 121 | 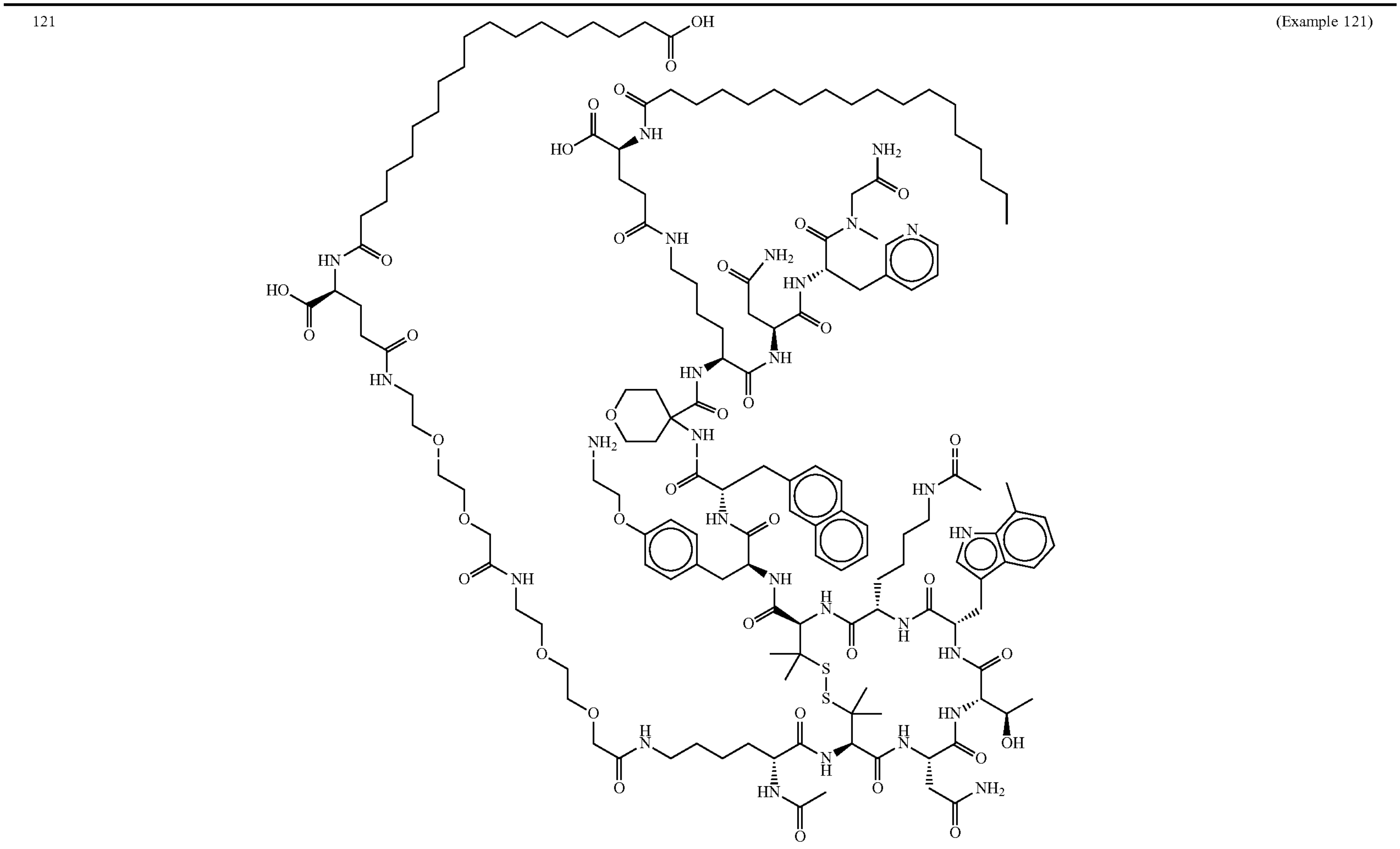 | (Example 121) |

TABLE 1E-continued
| Compounds | | |
|---|---|---|
| SEQ ID | Structure | |
| 122 | 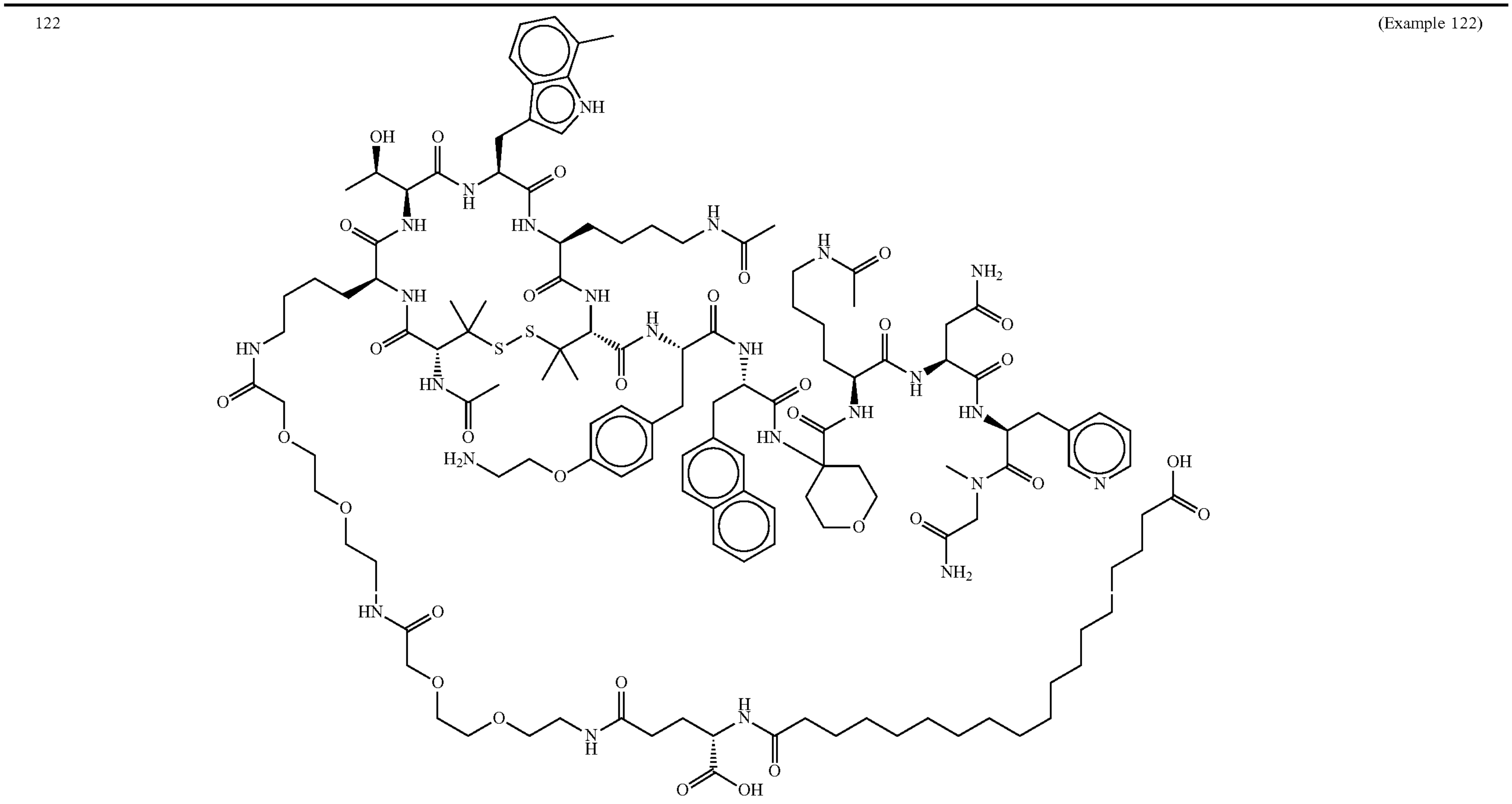 | (Example 122) |

TABLE 1E-continued
| Compounds | | |
|---|---|---|
| SEQ ID | Structure | |
| 123 | 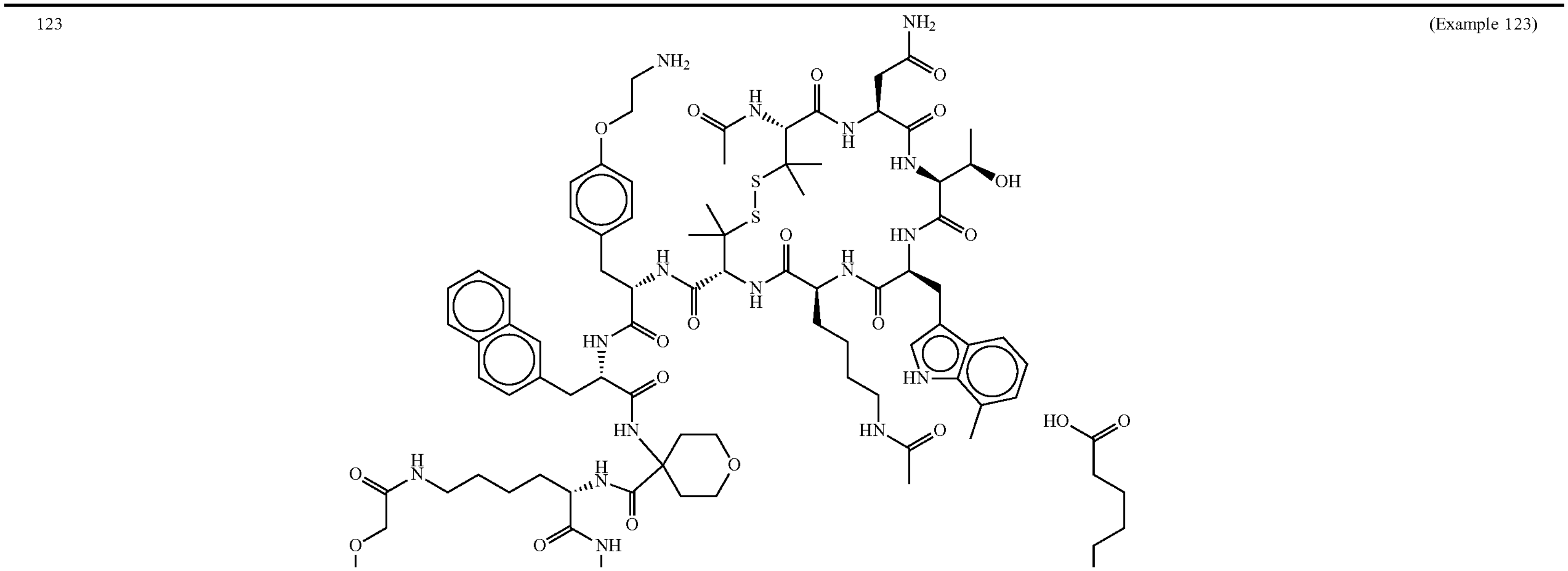 | (Example 123) |

TABLE 1E-continued
| Compounds | |
|---|---|
| SEQ ID | Structure |
| | 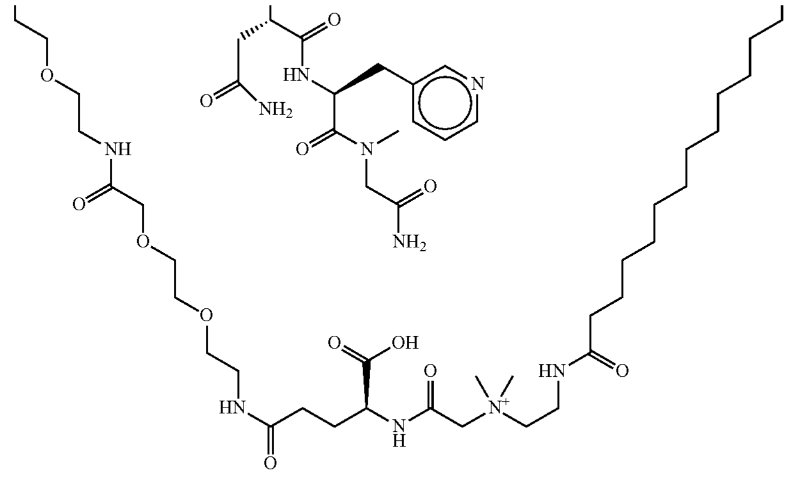 |

TABLE 1F
| Compounds. | |
|---|---|
| SEQ ID | Structure |
| 124 | 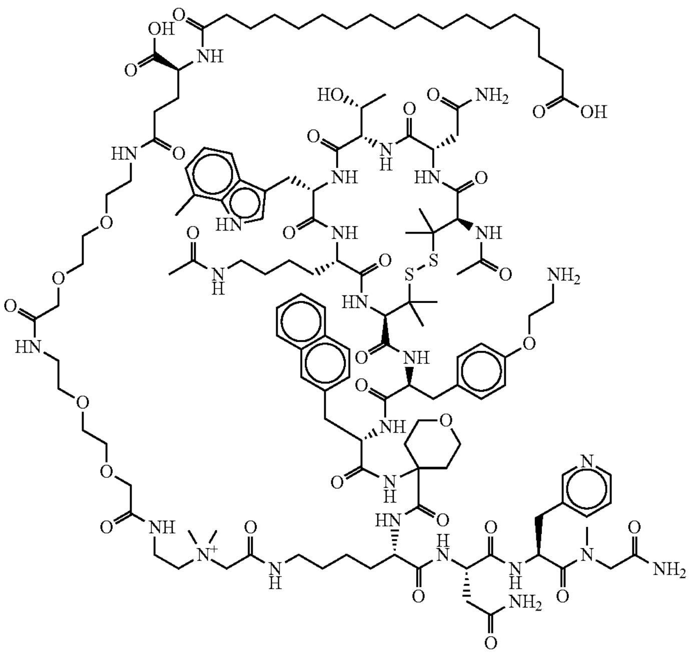 (Example 124) |
| 125 | 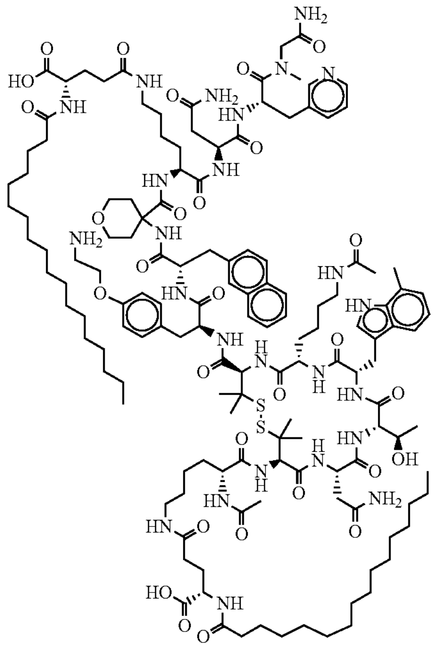 (Example 125) |

TABLE 1F-continued
| Compounds. | |
|---|---|
| SEQ ID | Structure |
| 126 | 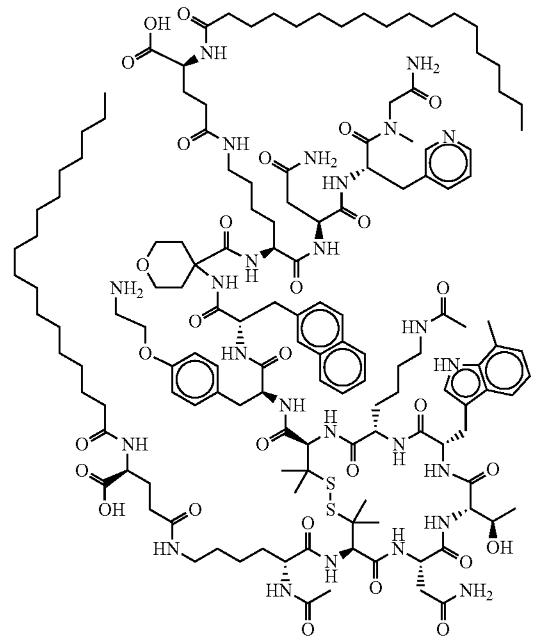<br>(Example 126) |
| 127 | 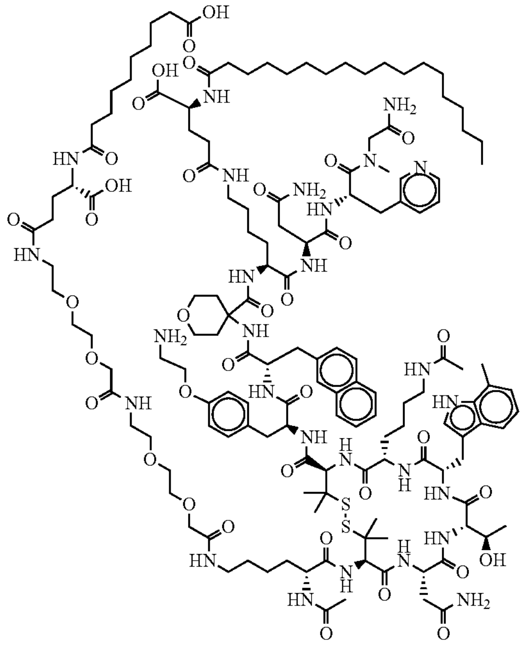<br>(Example 127) |

TABLE 1F-continued
| Compounds. | |
|---|---|
| SEQ ID | Structure |
| 128 | 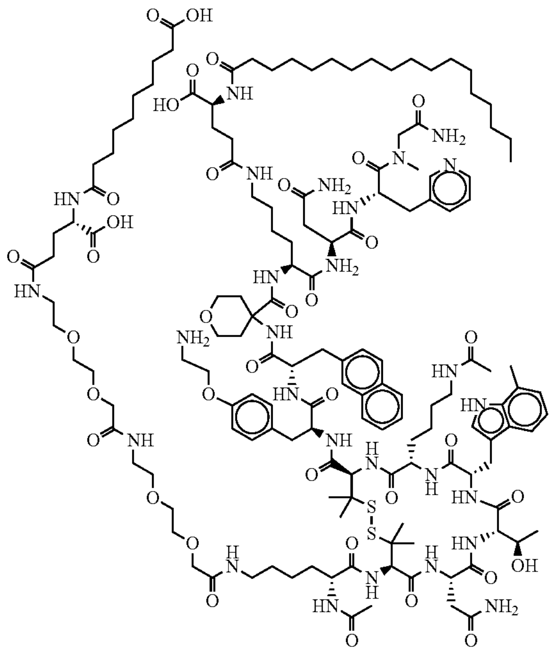 (Example 128) |
| 129 | 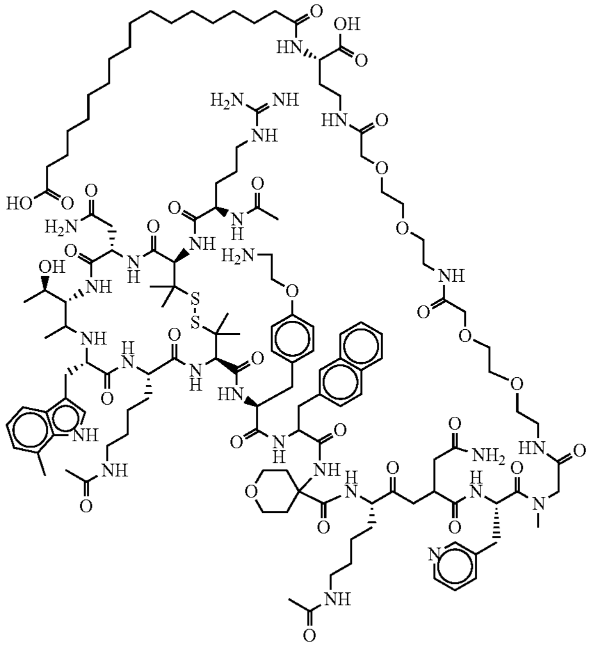 (Example 129) |

TABLE 1F-continued
| Compounds. | |
|---|---|
| SEQ ID | Structure |
| 130 | 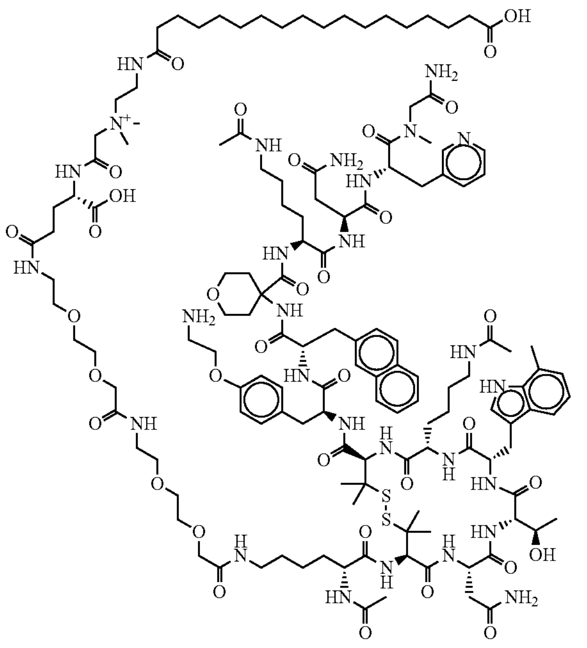 (Example 130) |
| 131 | 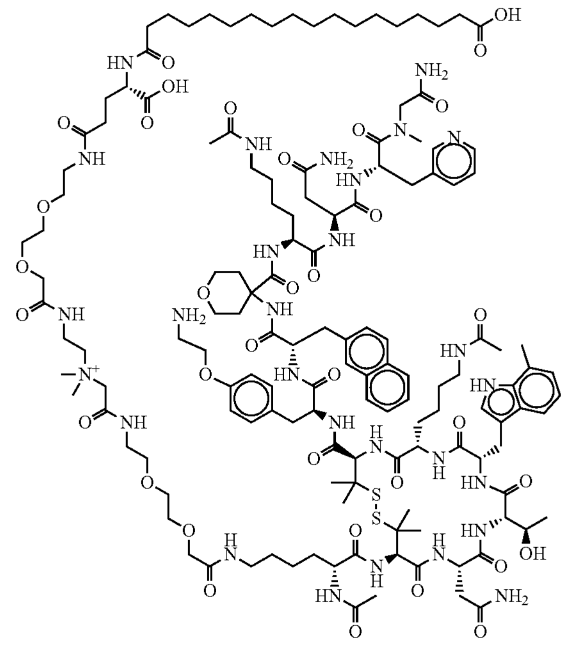 (Example 131) |

TABLE 1F-continued
| Compounds. | |
|---|---|
| SEQ ID | Structure |
| 132 | 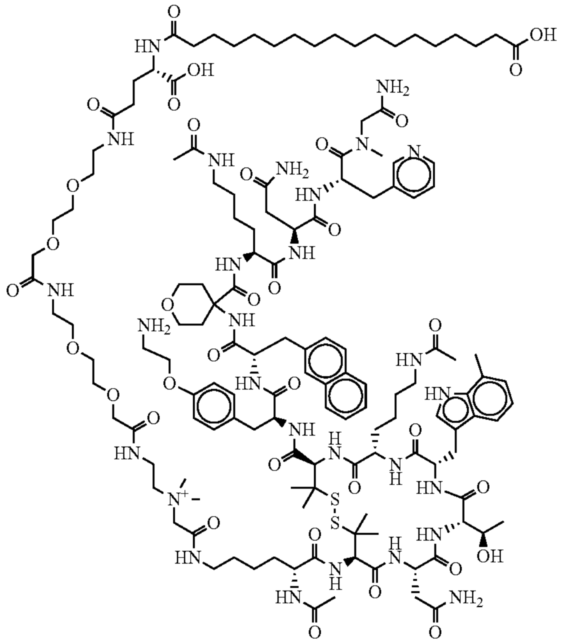 (Example 132) |
| 133 | 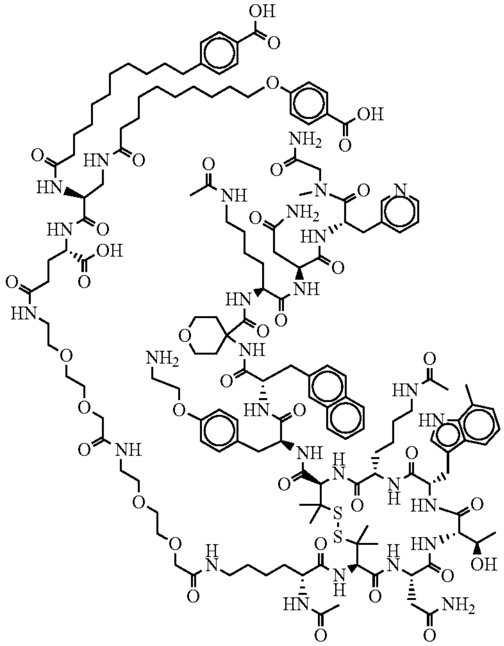 (Example 133) |

TABLE 1F-continued
| Compounds. | |
|---|---|
| SEQ ID | Structure |
| 134 | 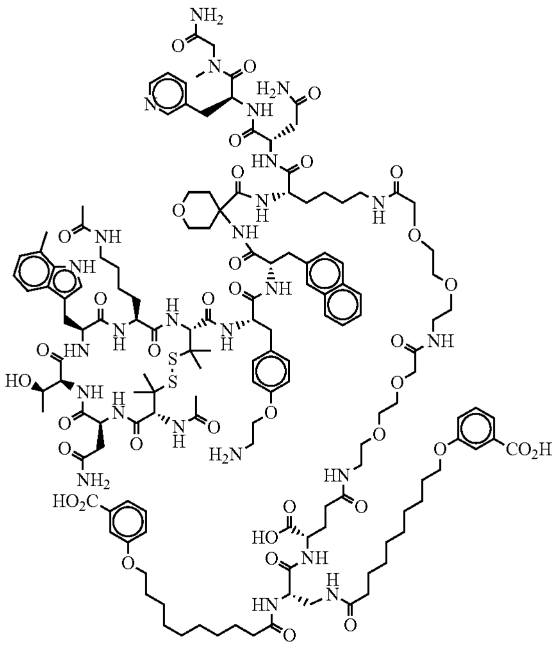 (Example 134) |
| 135 | 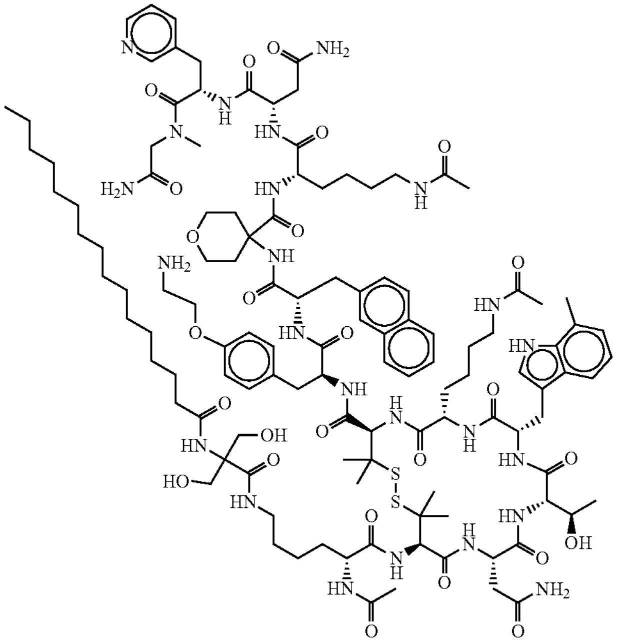 (Example 135) |

TABLE 1F-continued
| Compounds. | |
|---|---|
| SEQ ID | Structure |
| 136 | 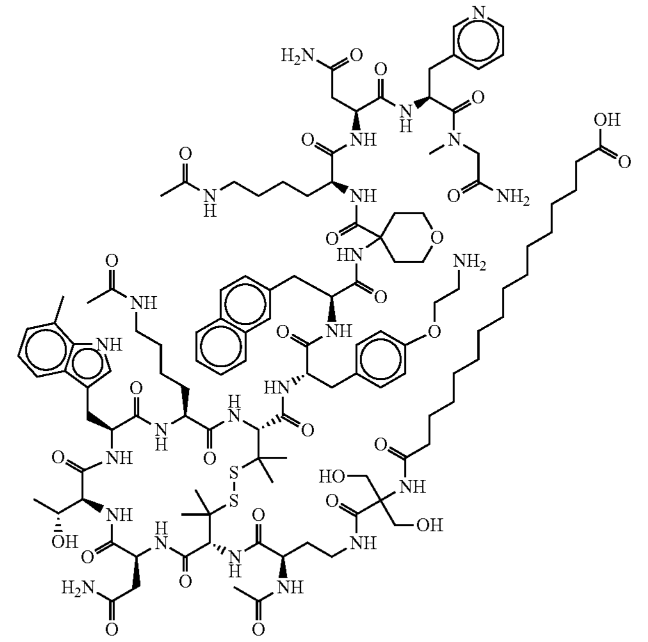 (Example 136) |
| 137 | 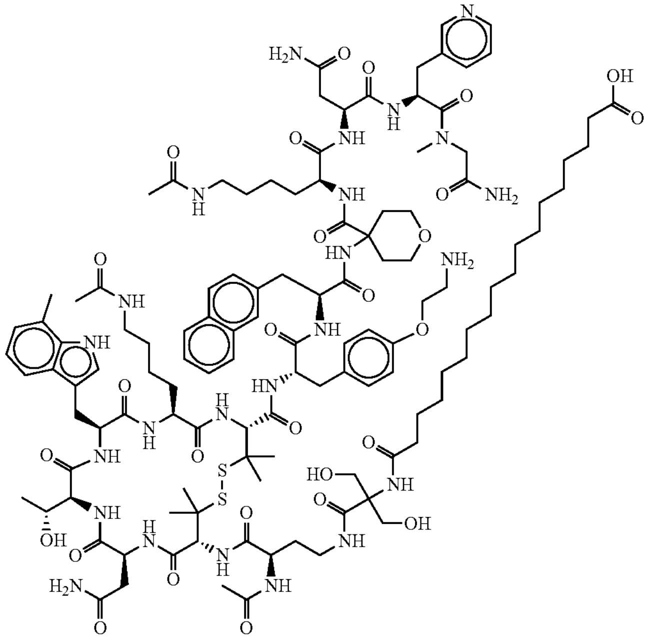 (Example 137) |

TABLE 1F-continued
| Compounds. | |
|---|---|
| SEQ ID | Structure |
| 138 | 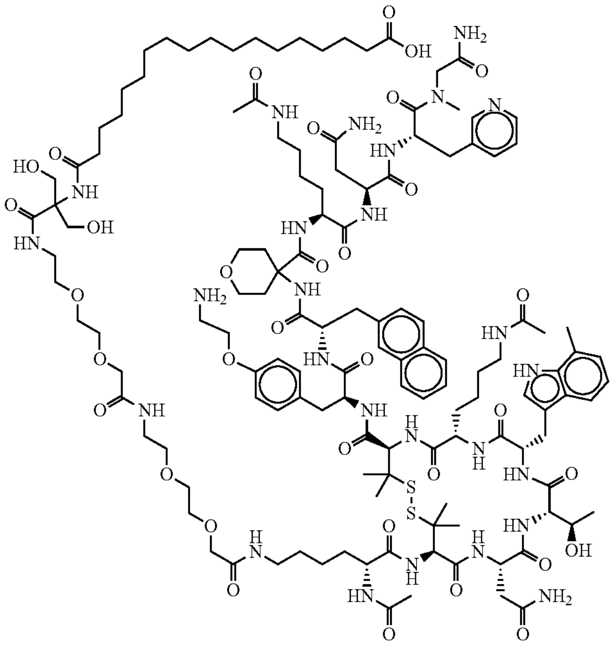 (Example 138) |
| 139 | 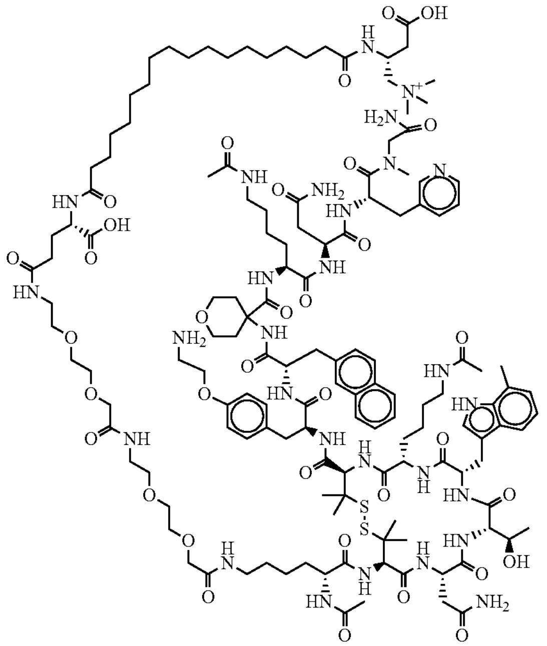 (Example 139) |

TABLE 1F-continued
| Compounds. | |
|---|---|
| SEQ ID | Structure |
| 140 | 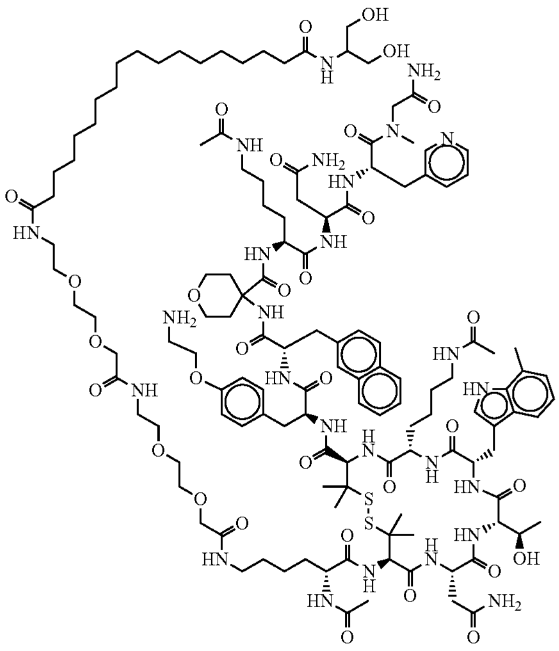<br>(Example 140) |
| 141 | 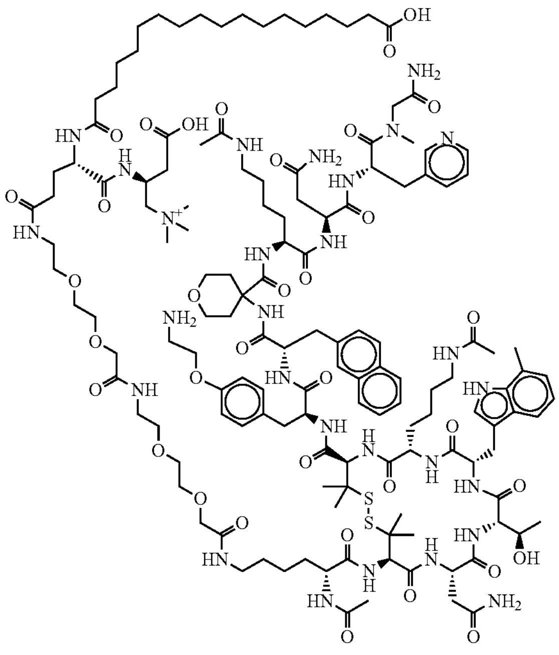<br>(Example 141) |

TABLE 1F-continued
| Compounds. | |
|---|---|
| SEQ ID | Structure |
| 142 | 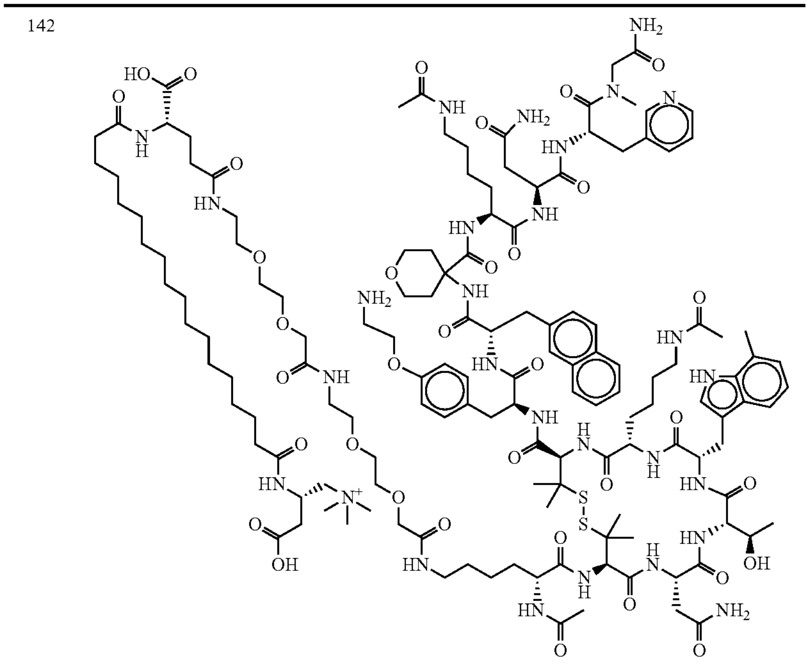 |
| | (Example 142) |

TABLE 1G
| Compounds. | |
|---|---|
| SEQ ID | Structure |
| 143 | Ac-[Pen]-L-T-[Trp(7-Me)]-Lys(PEG12_OMe)]-[Pen]-[Phe(4-OMe)]-[2Nal]-[aMeLeu]-L-N-[3Pal]-[Sarc]-NH2 (Example 201)<br>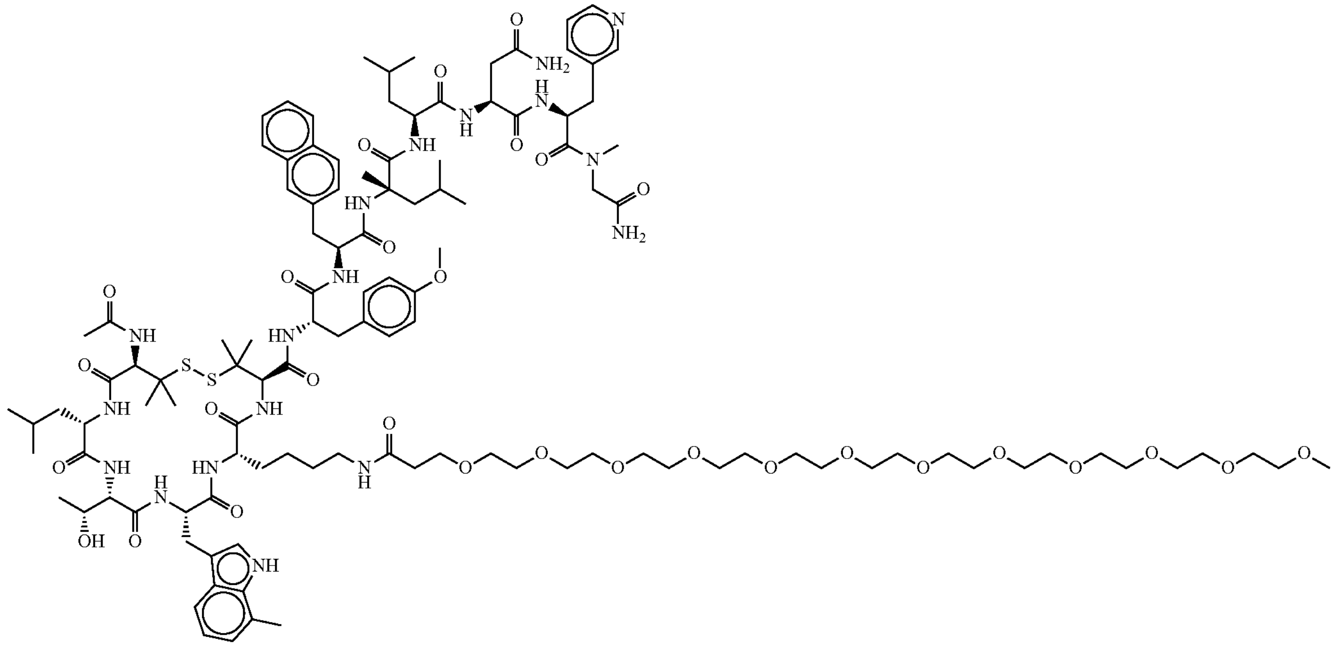 |

TABLE 1G-continued
| Compounds. | |
|---|---|
| SEQ ID | Structure |
| 144 | Ac-[Pen]-N-T-[Trp(7-Me)]-Lys(PEG12_OMe)]-[Pen]-[Phe(4-OMe)]-[2Nal]-[aMeLeu]-L-N-[3Pal]-[Sarc]-NH2 (Example 202) 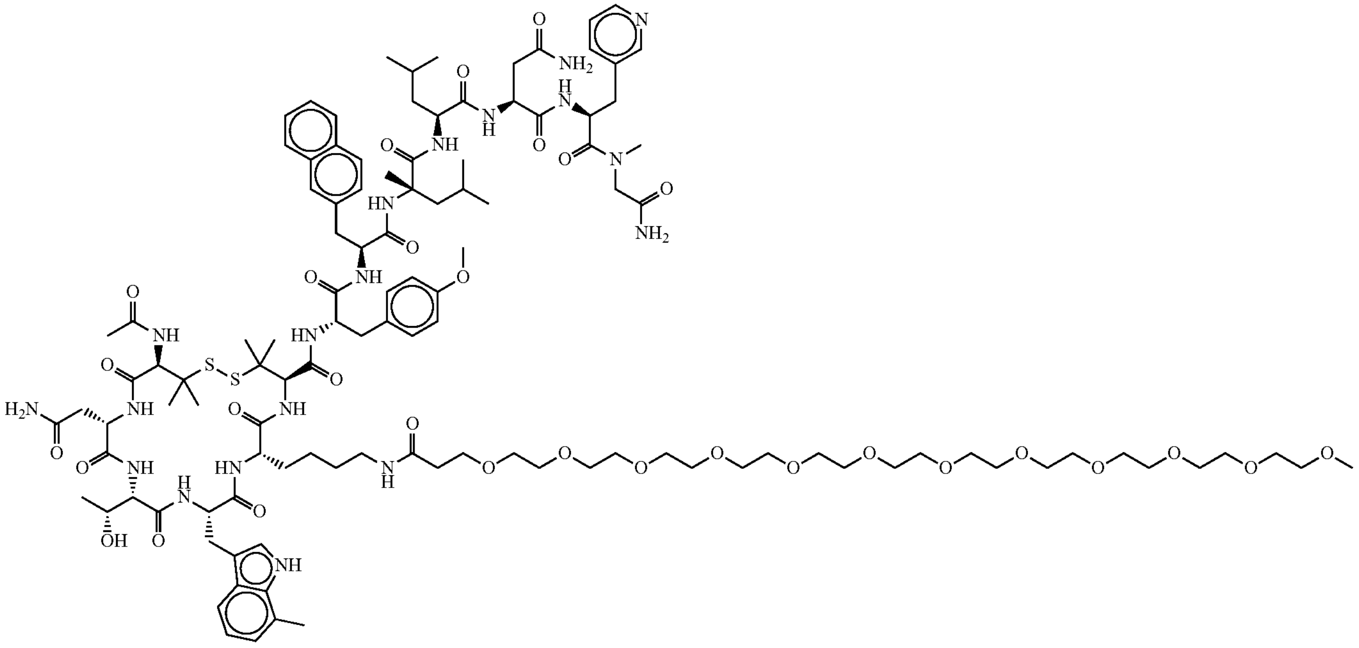 |

TABLE 1G-continued
| Compounds. | |
|---|---|
| SEQ ID | Structure |
| 145 | Ac-[Lys(PEG12_OMe)]-[Pen]-L-T-[Trp(7-Me)]-[Lys(Ac)]-[Pen]-[Phe(4-OMe)]-[2Nal]-[aMeLeu]-L-N-[3Pal]-[Sarc]-NH2 (Example 203)<br>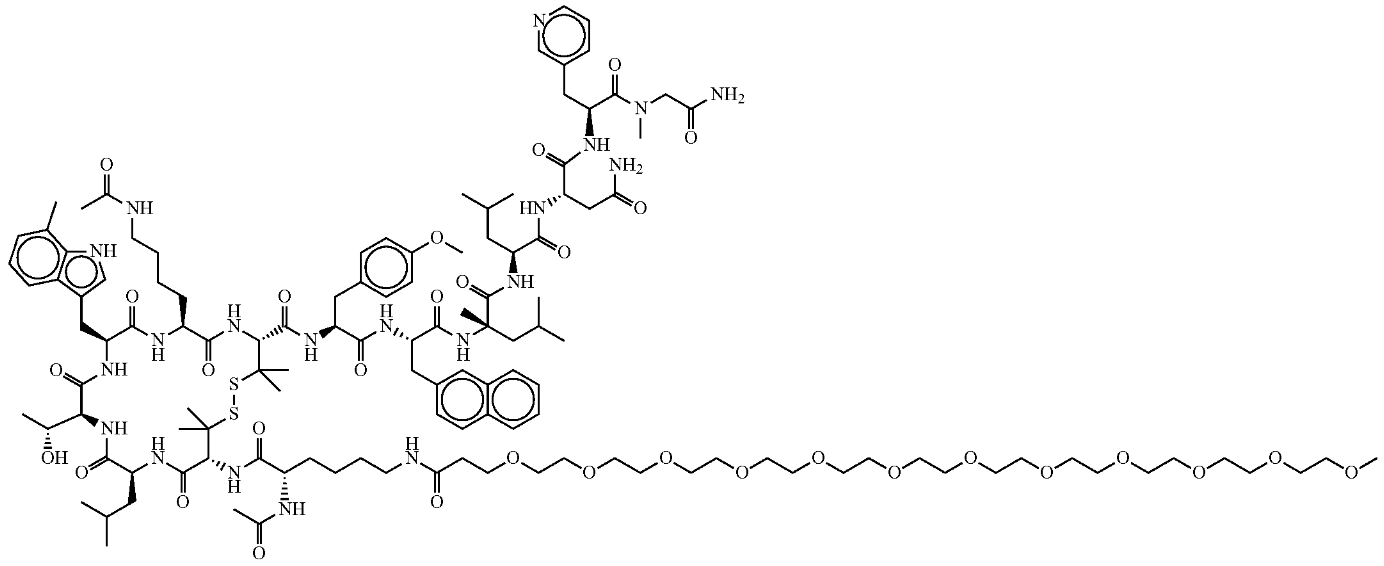 |

TABLE 1G-continued
| Compounds. | |
|---|---|
| SEQ ID | Structure |
| 146 | Ac-[Lys(PEG12_OMe)]-[Pen]-N-T-[Trp(7-Me)]-[Lys(Ac)]-[Pen]-[Phe(4-OMe)]-[2Nal]-[aMeLeu]-L-N-[3Pal]-[Sarc]-NH2 (Example 204) 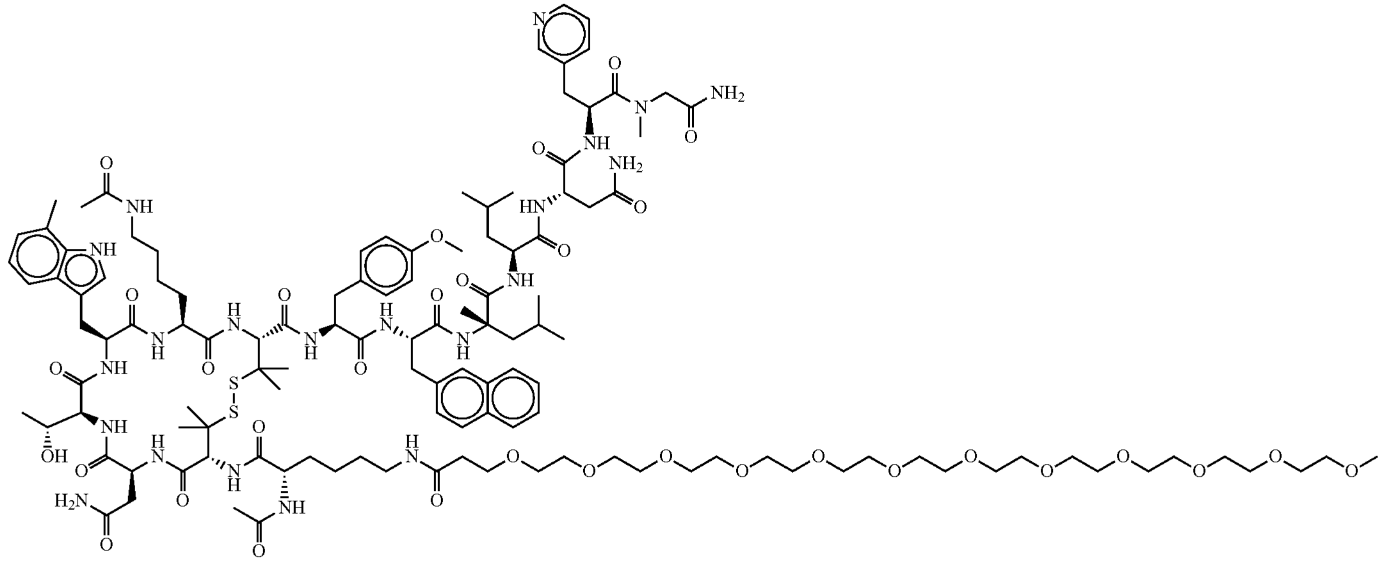 |

TABLE 1G-continued
| Compounds. | |
|---|---|
| SEQ ID | Structure |
| 147 | Ac-[Lys(PEG12_OMe)]-[Pen]-N-T-[Trp(7-Me)]-[Lys(Ac)]-[Pen]-F-[2Nal]-[aMeLeu]-L-N-[3Pal]-[Sarc]-NH2 (Example 205)<br>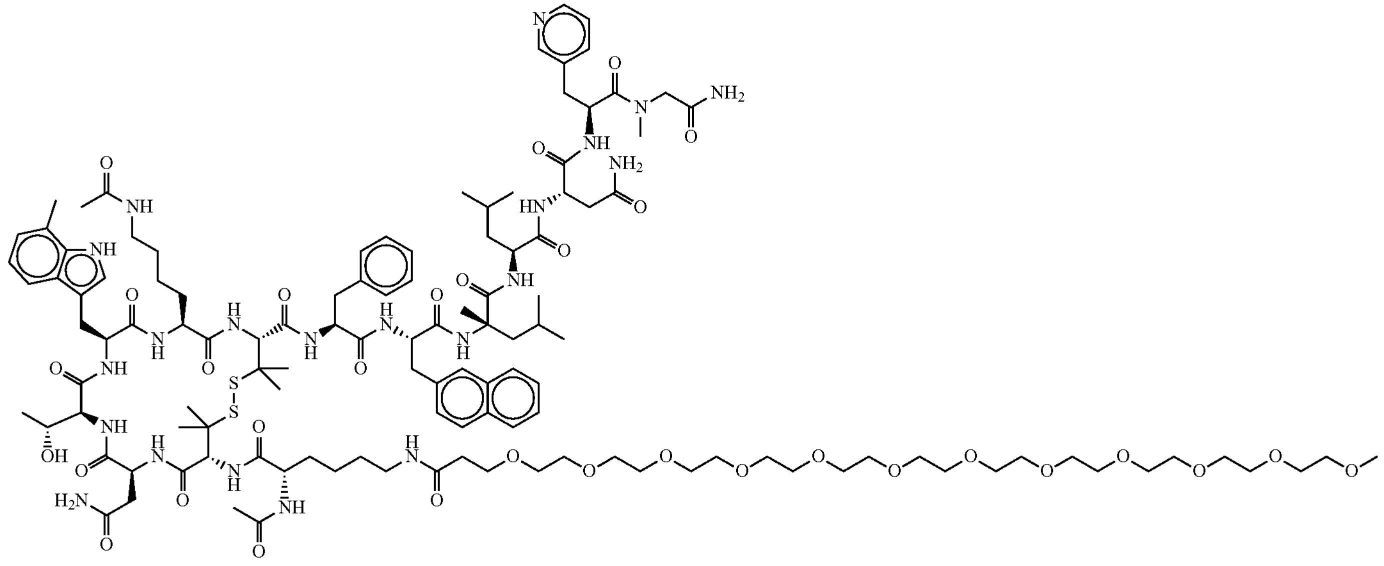 |

TABLE 1G-continued
| Compounds. | |
|---|---|
| SEQ ID | Structure |
| 148 | Ac-[Lys(PEG12_OMe)]-[Pen]-L-T-[Trp(7-Me)]-[Lys(Ac)]-[Pen]-F-[2Nal]-[aMeLeu]-L-N-[3Pal]-[Sarc]-NH2 (Example 206)<br>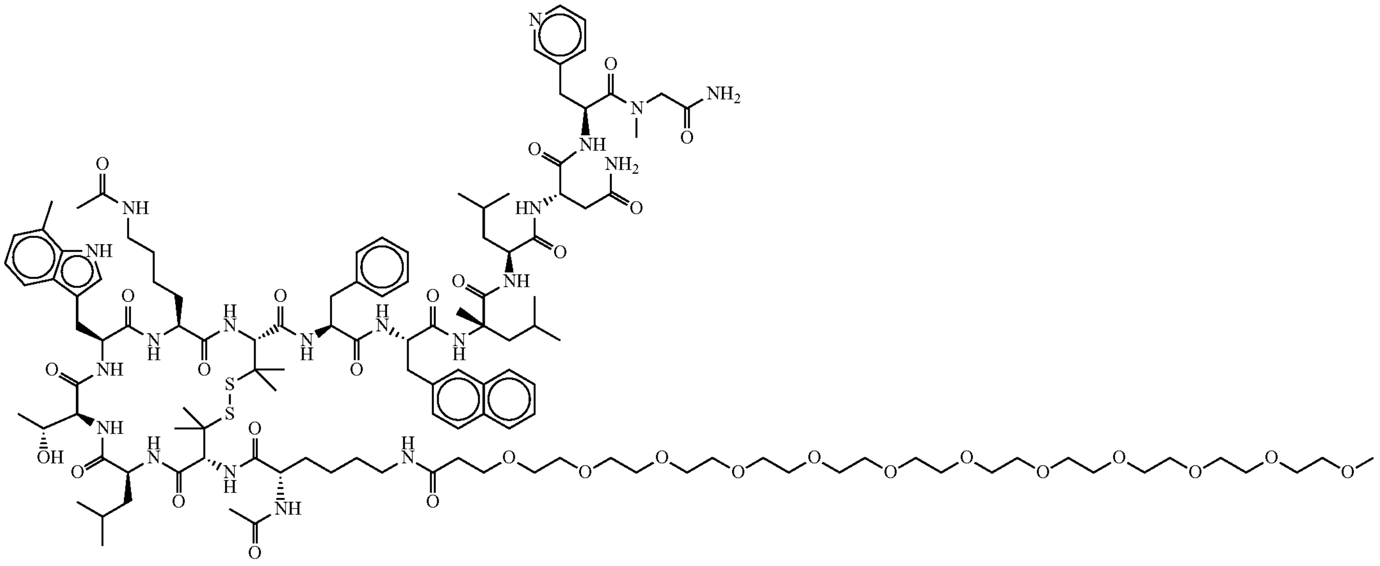 |

TABLE 1G-continued
| Compounds. | |
|---|---|
| SEQ ID | Structure |
| 149 | [PEG12_OMe]-[Pen]-N-T-[Trp(7-Me)]-[Lys(Ac)]-[Pen]-F-[2Nal]-[aMeLeu]-L-N-[3Pal]-[Sarc]-NH2 (Example 207) 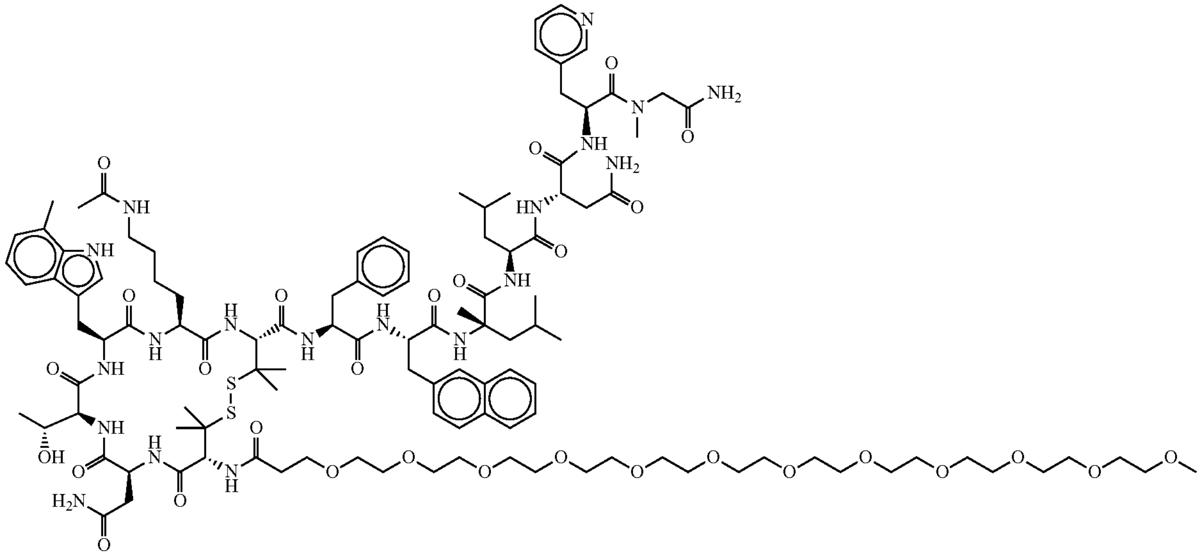 |

TABLE 1G-continued
| Compounds. | |
|---|---|
| SEQ ID | Structure |
| 150 | Ac-[Pen]-N-T-[Trp(7-Me)]-[Lys(PEG12_OMe)]-[Pen]-F-[2Nal]-[aMeLeu]-L-N-[3Pal]-[Sarc]-NH2 (Example 208) 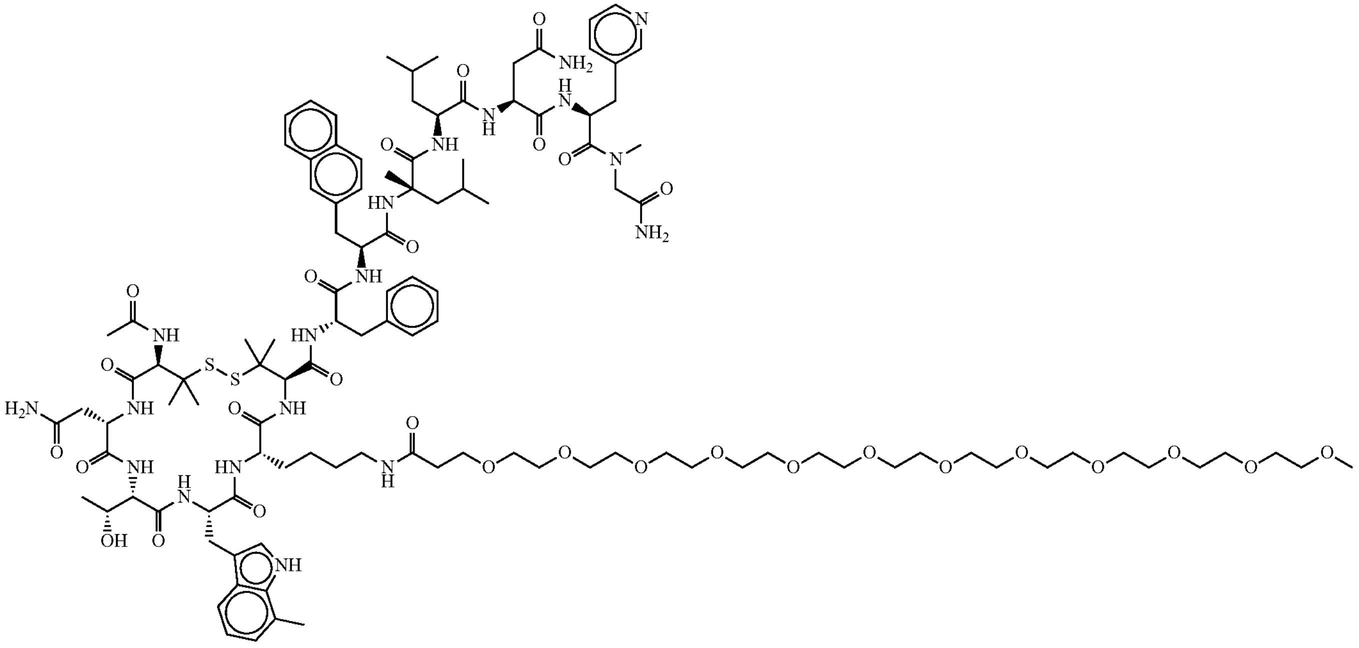 |

TABLE 1G-continued
| Compounds. | |
|---|---|
| SEQ ID | Structure |
| 151 | [PEG12_OMe]-[Pen]-L-T-[Trp(7-Me)]-[Lys(Ac)]-[Pen]-F-[2Nal]-[aMeLeu]-L-N-[3Pal]-[Sarc]-NH2 (Example 209)<br>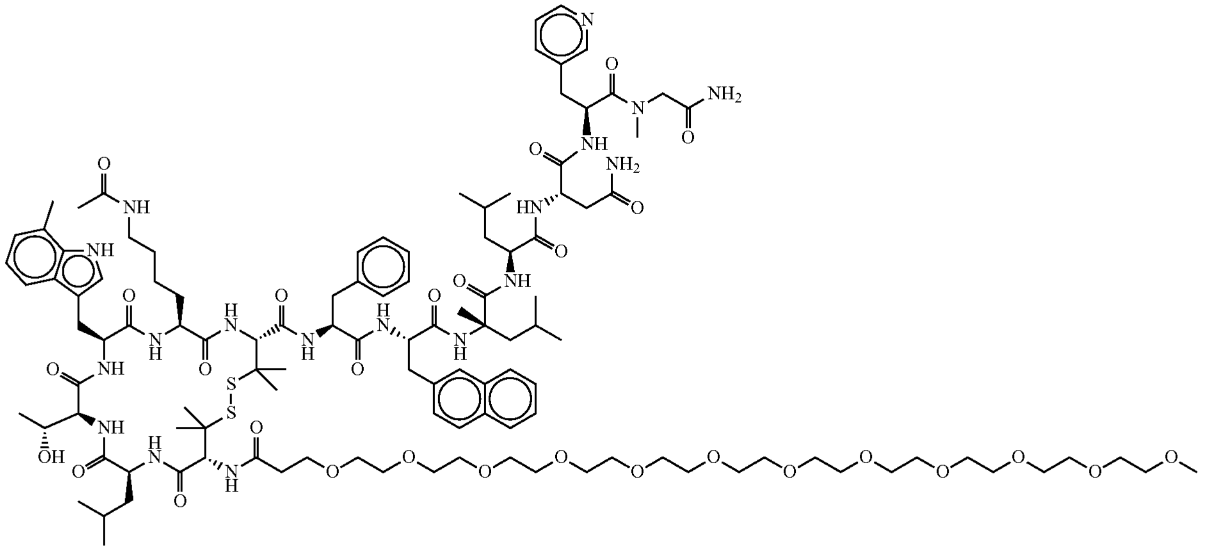 |

TABLE 1G-continued
| Compounds. | |
|---|---|
| SEQ ID | Structure |
| 152 | Ac-[Pen]-L-T-[Trp(7-Me)]-[Lys(PEG12_OMe)]-[Pen]-F-[2Nal]-[aMeLeu]-L-N-[3Pal]-[Sarc]-NH2 (Example 210)<br>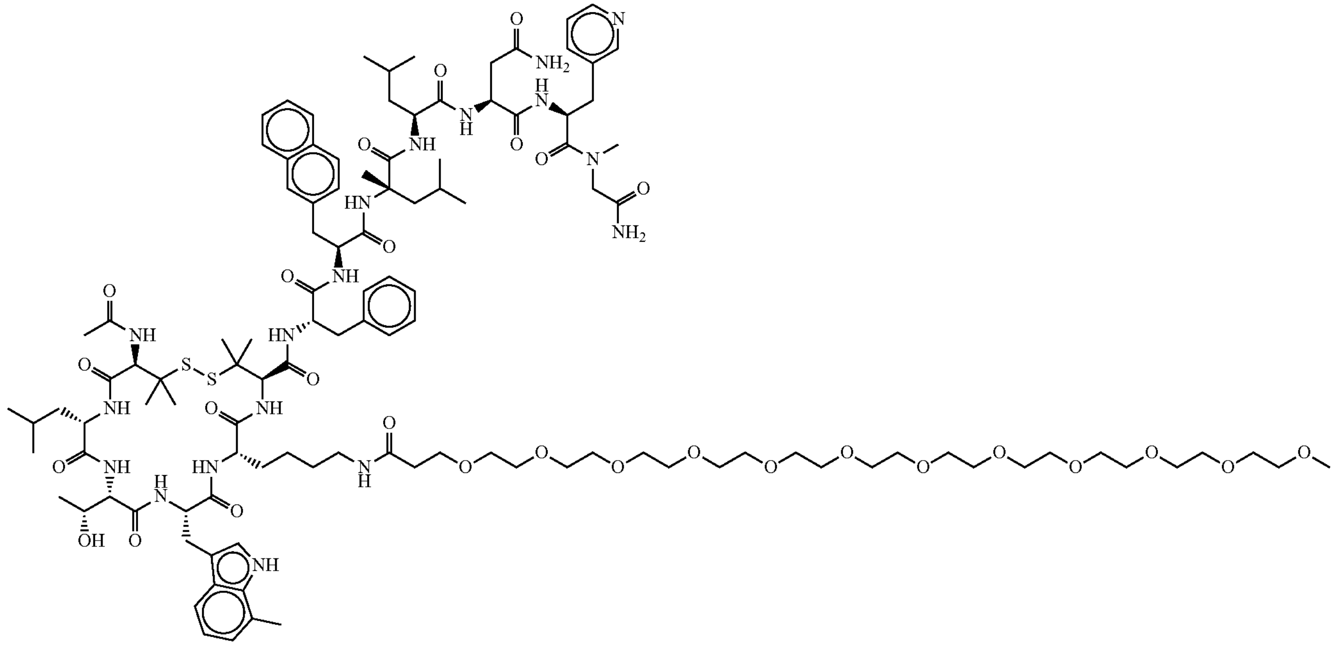 |

TABLE 1G-continued
| Compounds. | |
|---|---|
| SEQ ID | Structure |
| 153 | [PEG4_OMe]-[Pen]-N-T-[Trp(7-Me)]-[Lys(Ac)]-[Pen]-F-[2Nal]-[aMeLeu]-L-N-[3Pal]-[Sarc]-NH2 (Example 211)<br>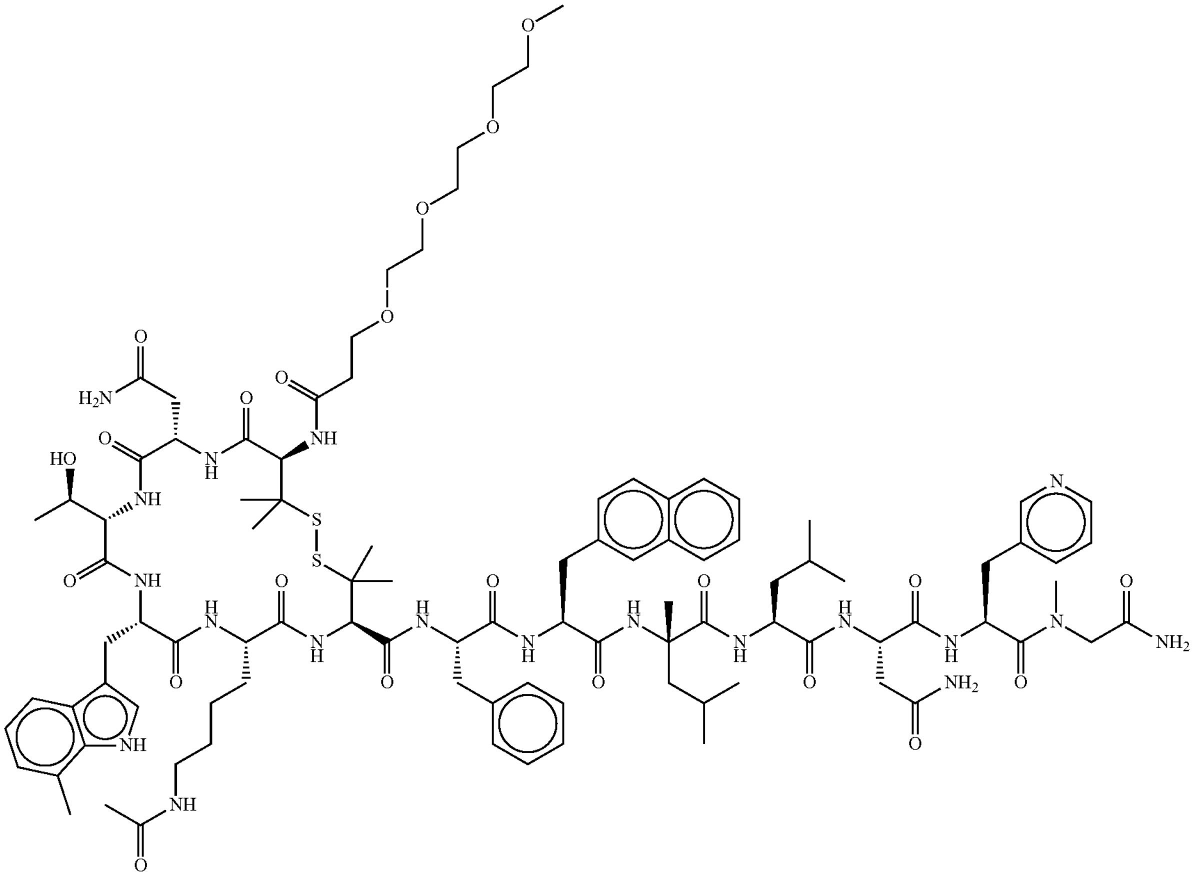 |

TABLE 1G-continued
| Compounds. | |
|---|---|
| SEQ ID | Structure |
| 154 | Ac-[Pen]-N-T-[Trp(7-Me)]-[Lys(PEG4)]-[Pen]-F-[2Nal]-[aMeLeu]-L-N-[3Pal]-[Sarc]-NH2 (Example 212) 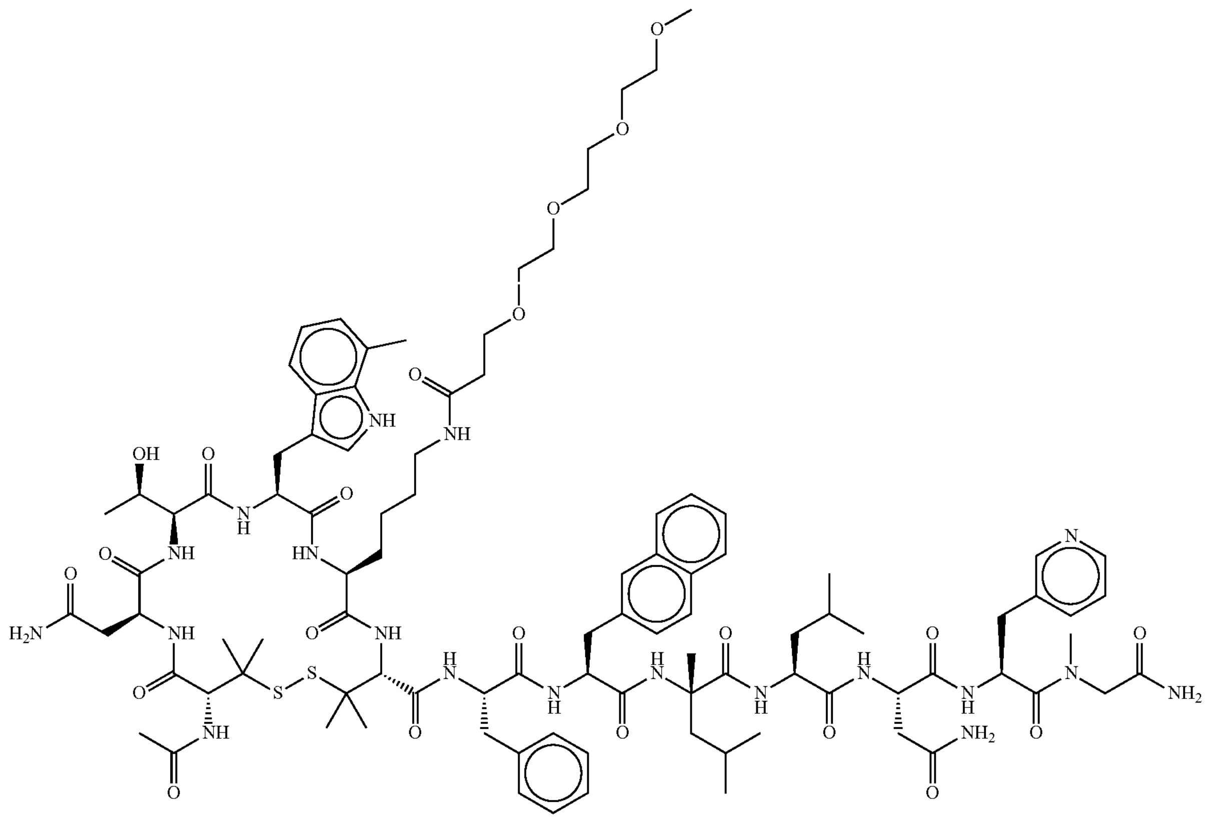 |

TABLE 1G-continued
| Compounds. | |
|---|---|
| SEQ ID | Structure |
| 155 | [PEG4_OMe]-[Pen]-L-T-[Trp(7-Me)]-[Lys(Ac)]-[Pen]-F-[2Nal]-[aMeLeu]-L-N-[3Pal]-[Sarc]-NH2 (Example 213)<br>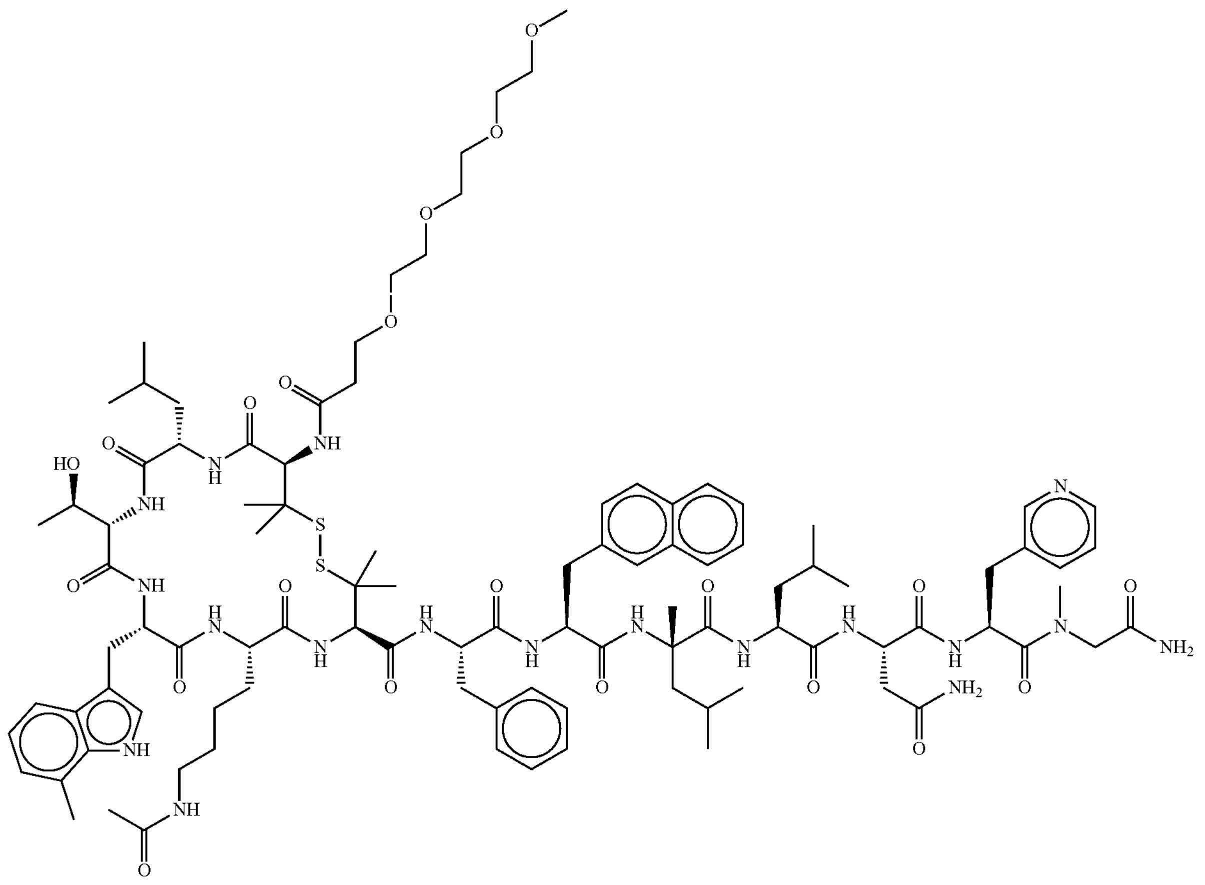 |

TABLE 1G-continued
| Compounds. | |
|---|---|
| SEQ ID | Structure |
| 156 | Ac-[Pen]-L-T-[Trp(7-Me)]-[Lys(PEG4)]-[Pen]-F-[2Nal]-[aMeLeu]-L-N-[3Pal]-[Sarc]-NH2 (Example 214) 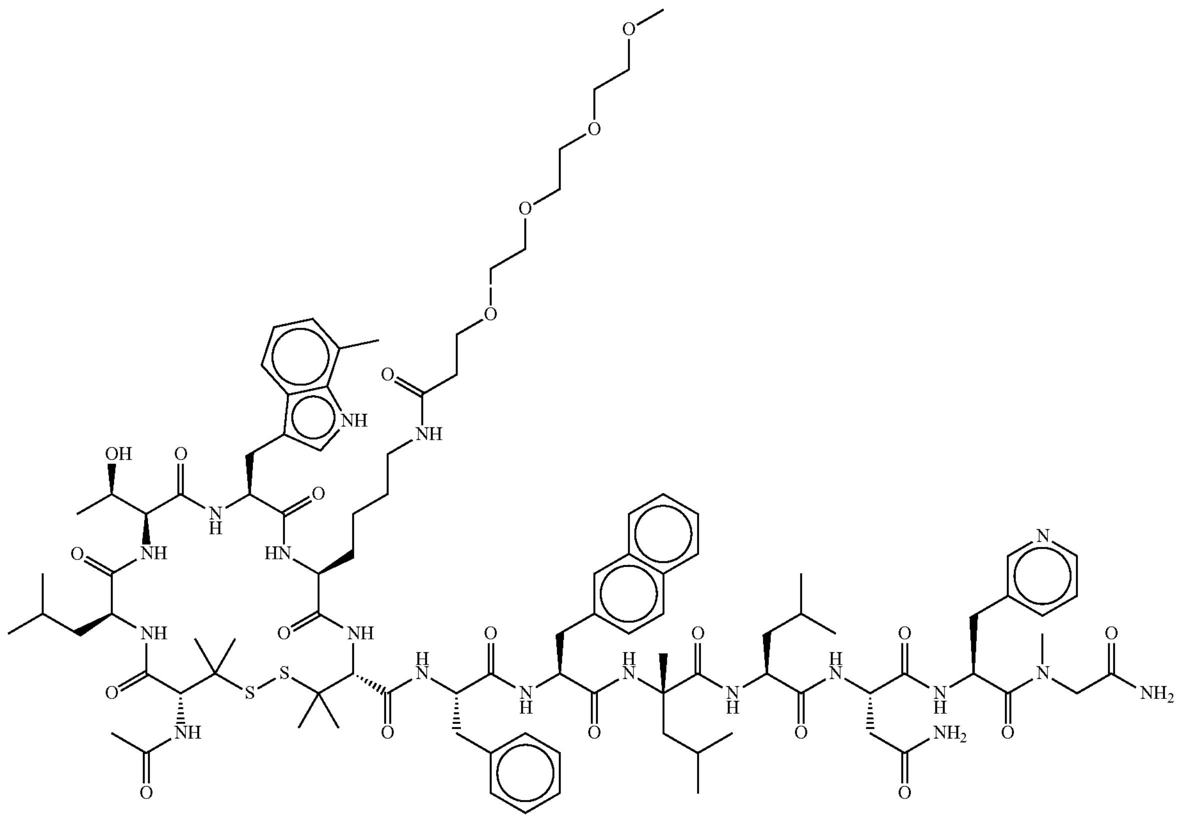 |

TABLE 1G-continued
| Compounds. | |
|---|---|
| SEQ ID | Structure |
| 157 | Ac-[Lys(PEG4)]-[Pen]-N-T-[Trp(7-Me)]-[Lys(Ac)]-[Pen]-F-[2Nal]-[aMeLeu]-L-N-[3Pal]-[Sarc]-NH2 (Example 215) 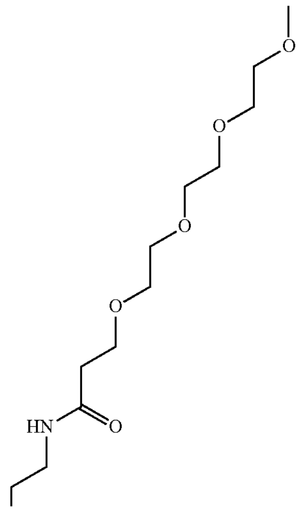 |

TABLE 1G-continued
| Compounds. | |
|---|---|
| SEQ ID | Structure |
| | 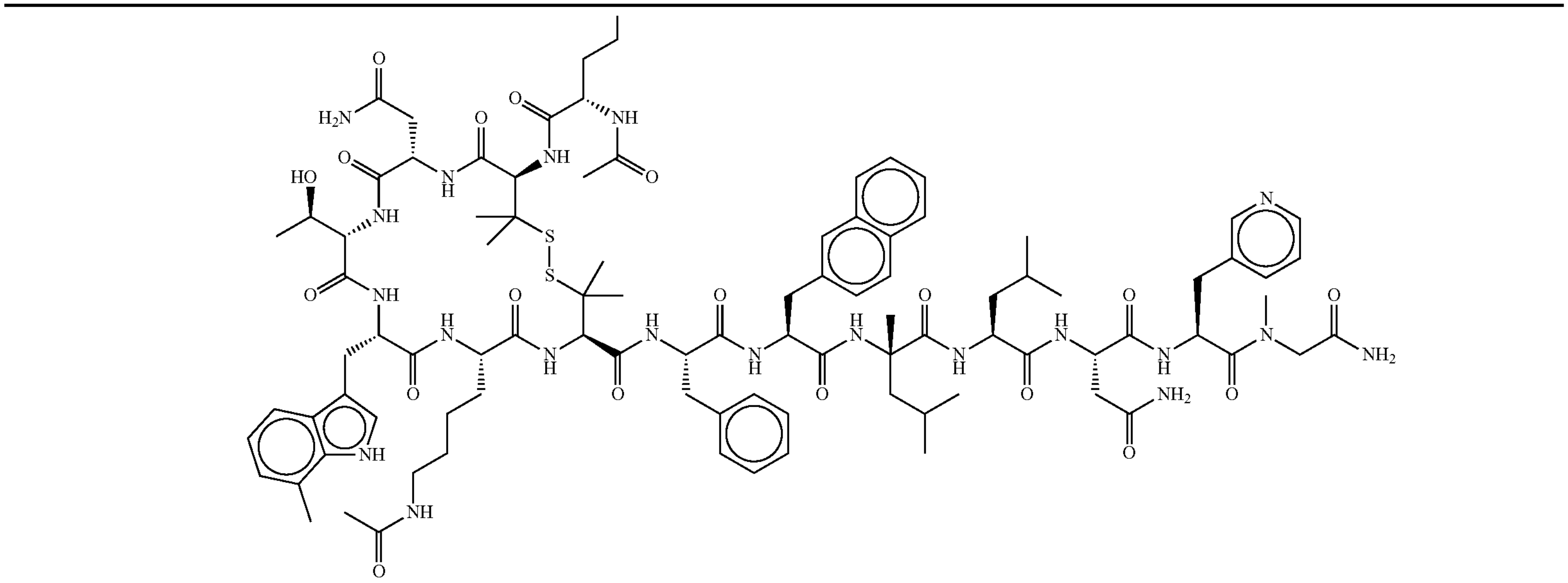 |

TABLE 1G-continued
| Compounds. | |
|---|---|
| SEQ ID | Structure |
| 158 | Ac-[Lys(PEG4)]-[Pen]-L-T-[Trp(7-Me)]-[Lys(Ac)]-[Pen]-F-[2Nal]-[aMeLeu]-L-N-[3Pal]-[Sarc]-NH2 (Example 216) 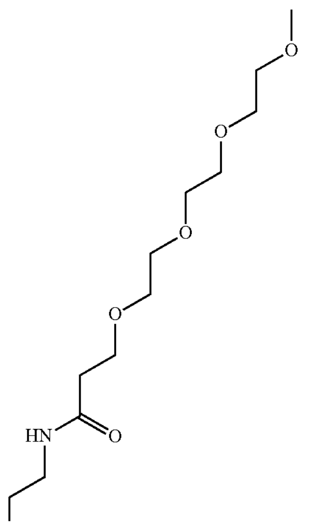 |

TABLE 1G-continued
| Compounds. | |
|---|---|
| SEQ ID | Structure |
| | 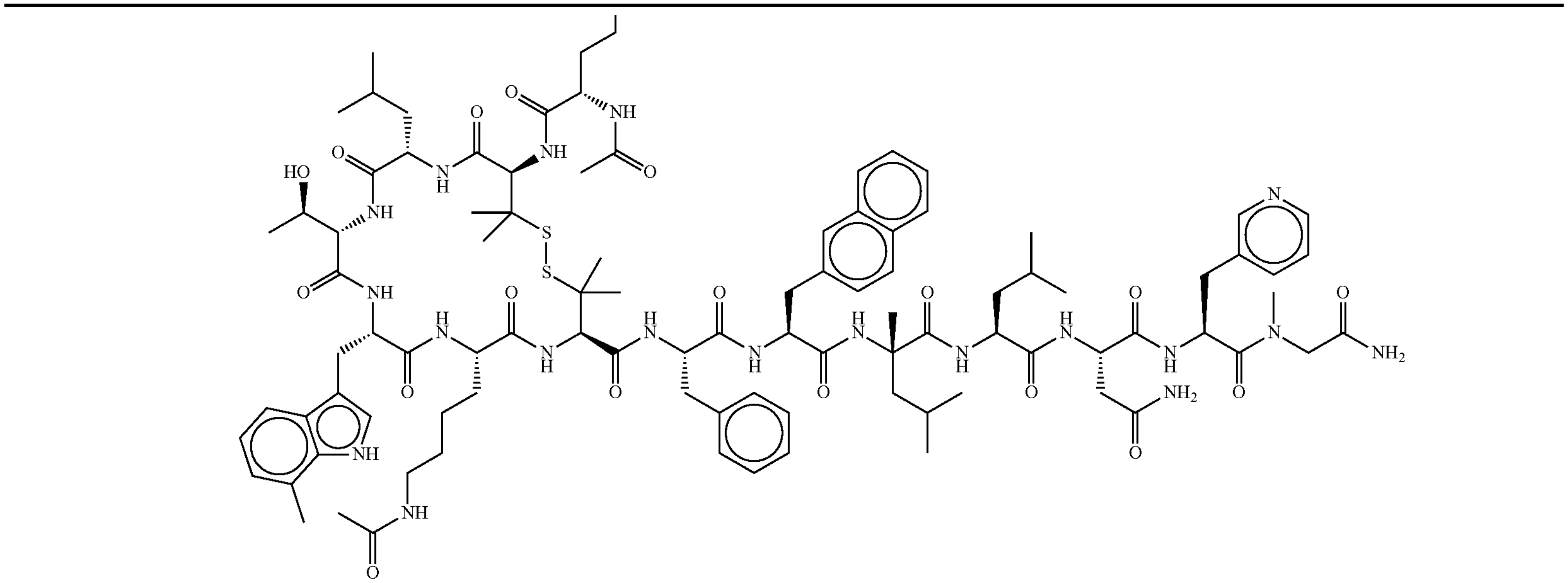 |

TABLE 1G-continued
| Compounds. | |
|---|---|
| SEQ ID | Structure |
| 159 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-E-L-[3Pal]-[Sarc]-NH2 (Example 217)<br>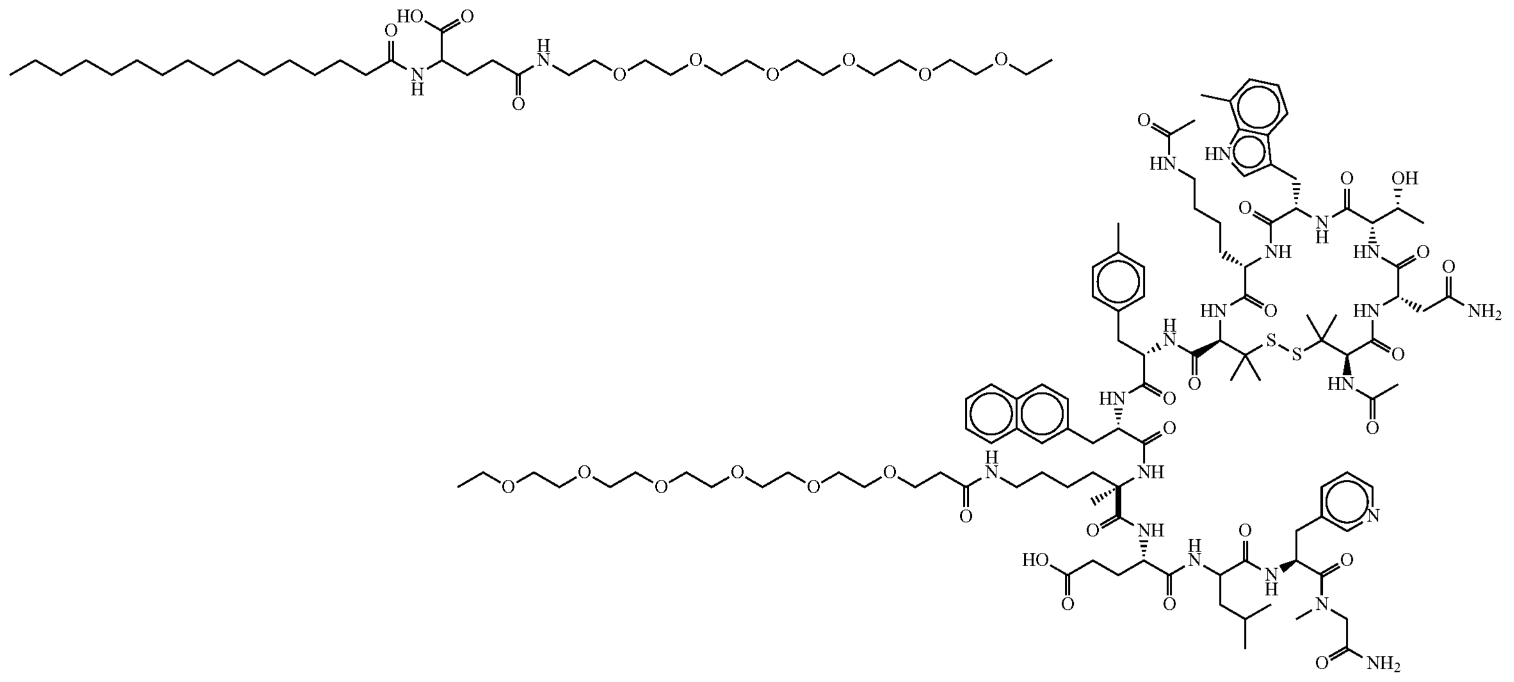 |

TABLE 1G-continued
| Compounds. | |
|---|---|
| SEQ ID | Structure |
| 160 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-[Lys(Ac)]-L-[3Pal]-[Sarc]-NH2 (Example 218) 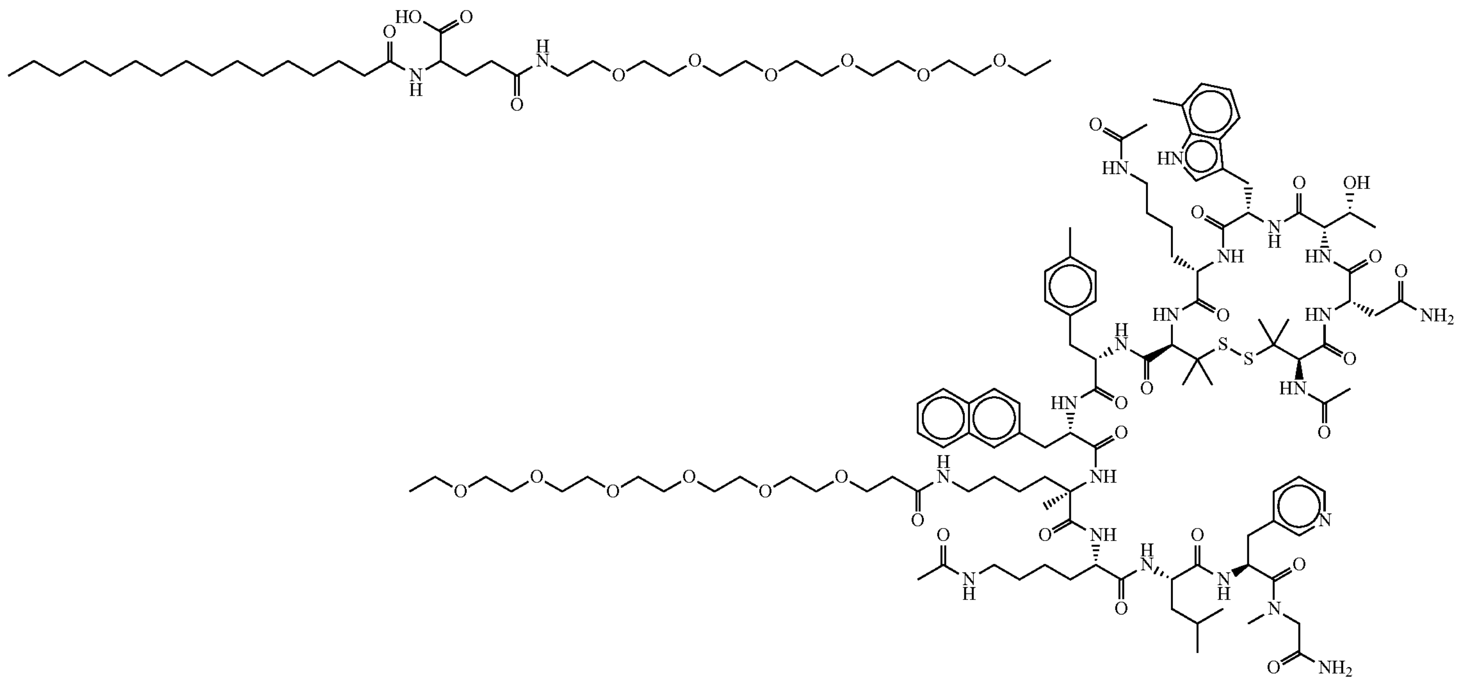 |

TABLE 1G-continued
| Compounds. | |
|---|---|
| SEQ ID | Structure |
| 161 | Ac-[Pen]-N-T-[Trp(7-Me)]-[Lys(Ac)]-[Pen]-[2Nal]-[2Nal]-[aMeLys(PEG12_IsoGlu_Palm)]-E-L-[3Pal]-[Sarc]-NH2 (Example 219) 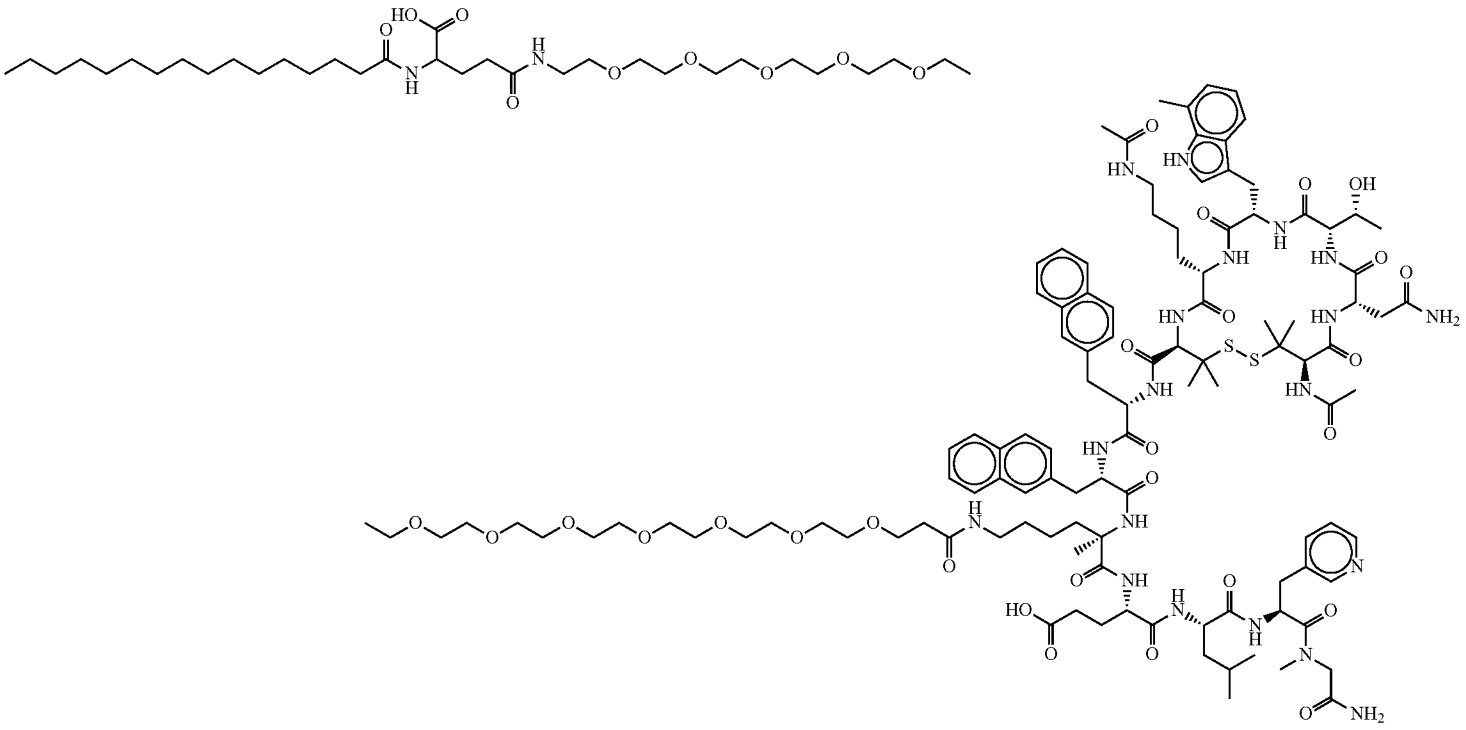 |

TABLE 1G-continued
| Compounds. | |
| --- | --- |
| SEQ ID | Structure |
| 162 | Ac-[Pen]-N-T-[Trp(7-Me)]-[Lys(Ac)]-[Pen]-[2Nal]-[2Nal]-[aMeLys(PEG12_IsoGlu_Palm)]-[Lys(Ac)]-L-[3Pal]-[Sarc]-NH2 (Example 220)<br>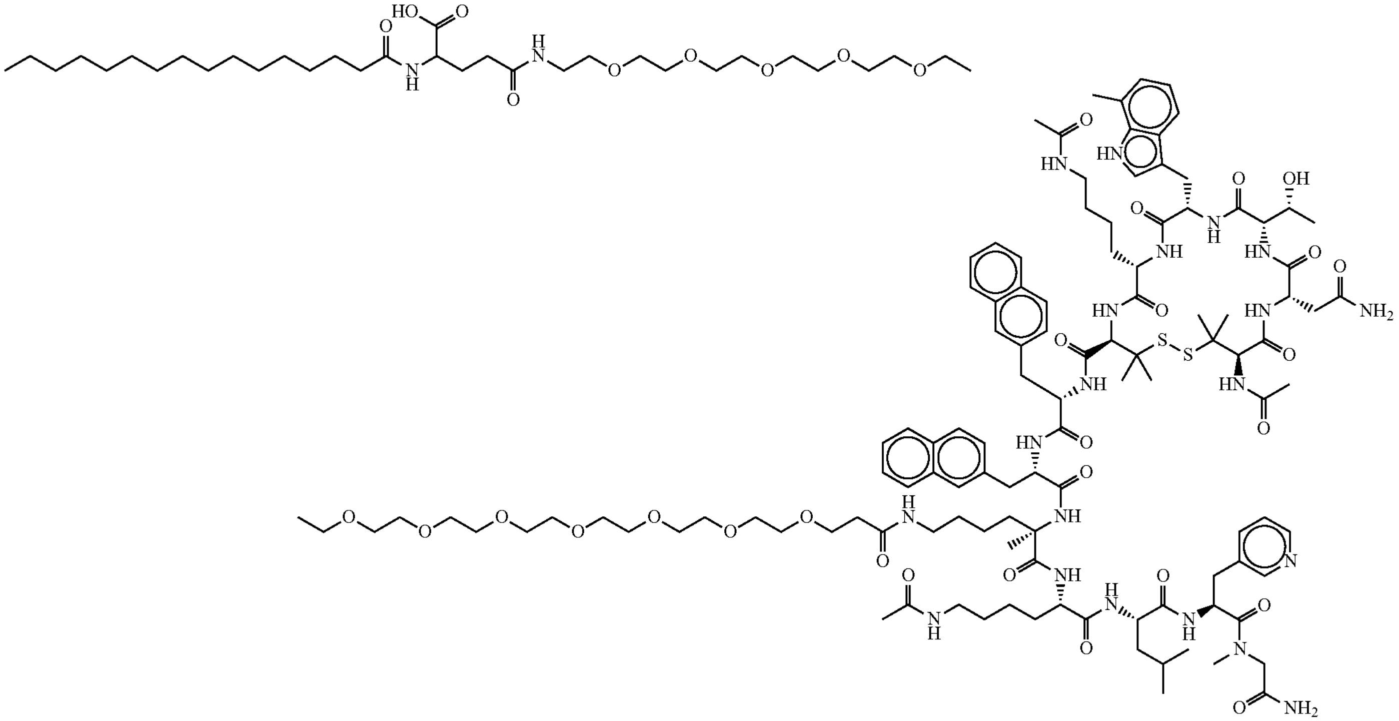 |

TABLE 1G-continued
| Compounds. | |
|---|---|
| SEQ ID | Structure |
| 163 | Ac-[Pen]-N-T-[Trp(7-Me)]-[Lys(Ac)]-[Pen]-F-[2Nal]-[aMeLys(PEG12_IsoGlu_Palm)]-L-L-[3Pal]-[Sarc]-NH2 (Example 221)<br>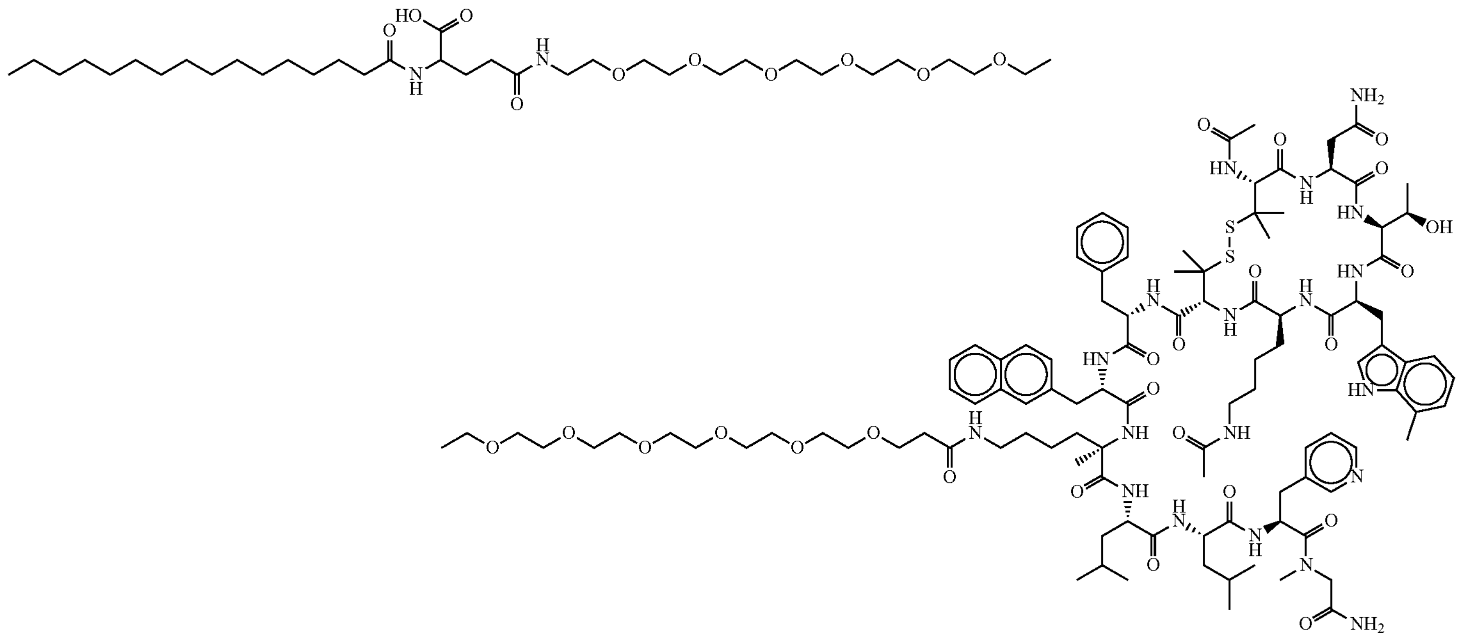 |

TABLE 1G-continued
| Compounds. | |
|---|---|
| SEQ ID | Structure |
| 164 | Ac-[Pen]-N-T-[Trp(7-Me)]-[Lys(Ac)]-[Pen]-F-[2Nal]-[aMeLys(PEG12_IsoGlu_Palm)]-E-L-[3Pal]-[Sarc]-NH2 (Example 222)<br>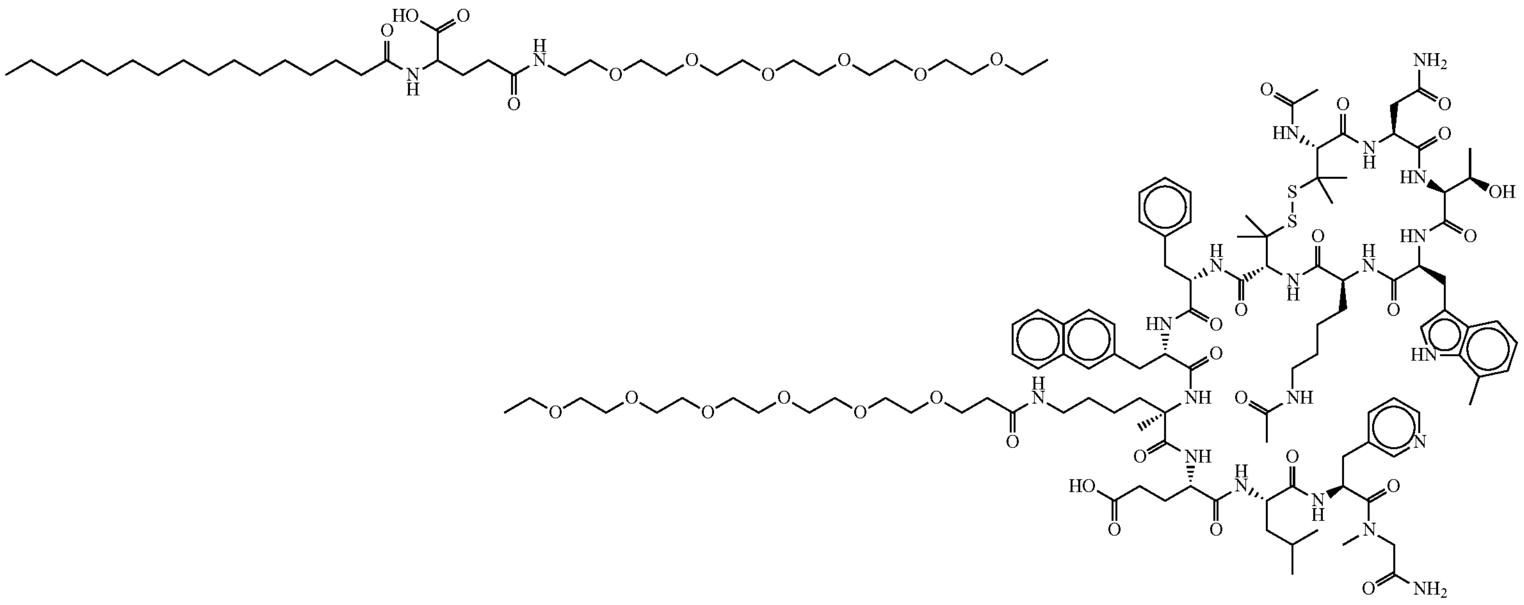 |

TABLE 1G-continued
| Compounds. | |
|---|---|
| SEQ ID | Structure |
| 165 | Ac-[Pen]-A-T-[Trp(7-Me)]-[Lys(Ac)]-[Pen]-[Phe(4-OMe)]-[2Nal]-[aMeLys(PEG12_IsoGlu_Palm)]-A-A-[3Pal]-[Sarc]-NH2 (Example 223)<br>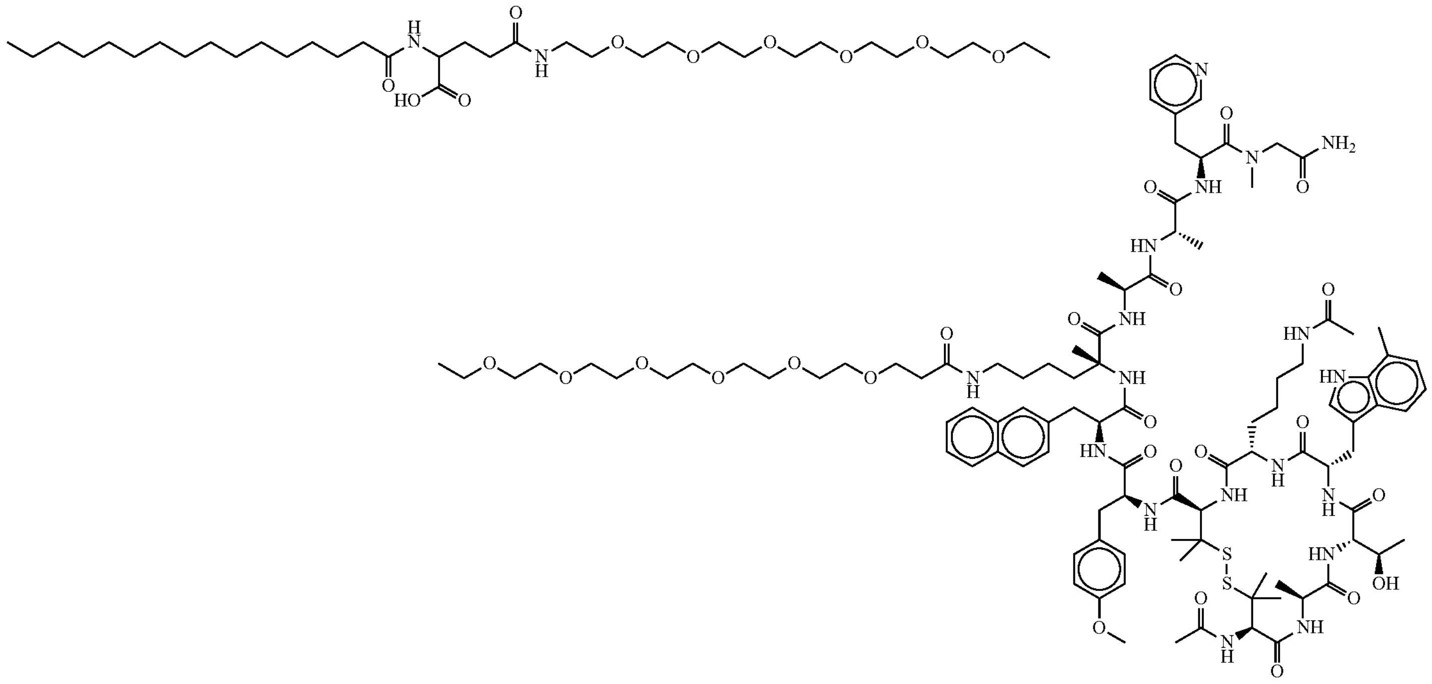 |

TABLE 1G-continued
| Compounds. | |
|---|---|
| SEQ ID | Structure |
| 166 | Ac-[Pen]-A-T-[Trp(7-Me)]-[Lys(Ac)]-[Pen]-[Phe(4-OMe)]-[2Nal]-[aMeLys(PEG12_IsoGlu_C18_Diacid)]-A-A-[3Pal]-[Sarc]-NH2 (Example 224)<br>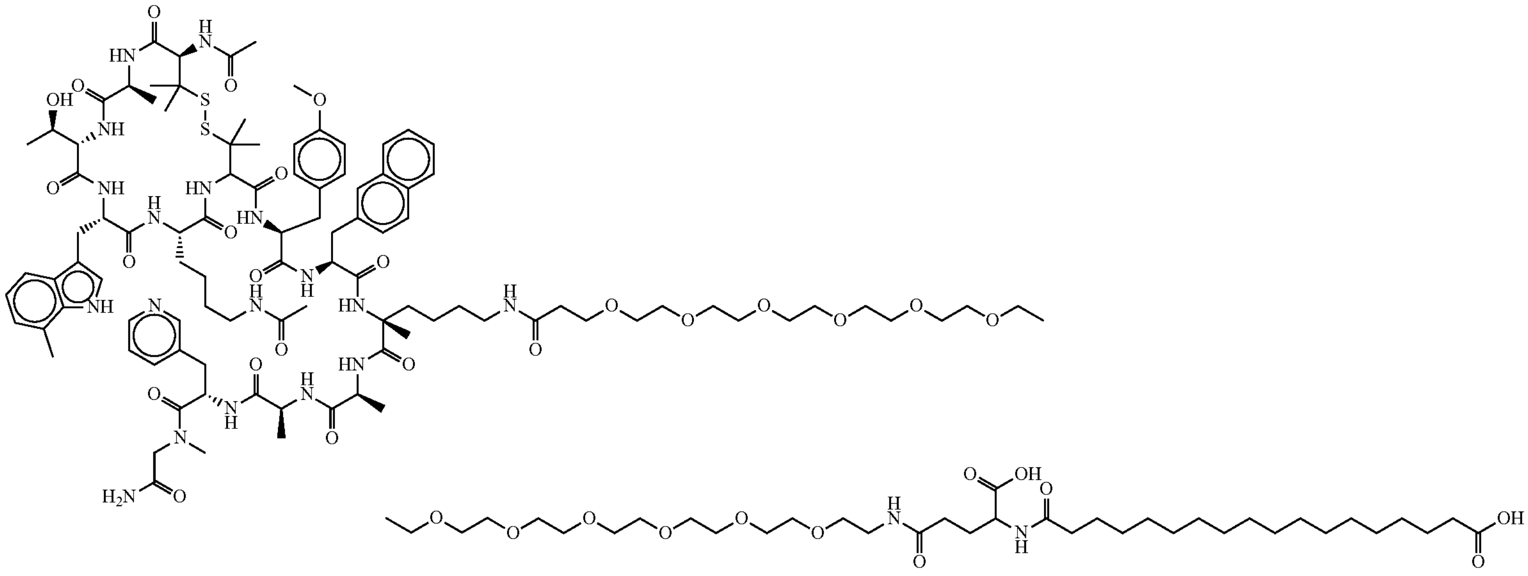 |

TABLE 1G-continued
| Compounds. | |
|---|---|
| SEQ ID | Structure |
| 167 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-A-A-[3Pal]-[Sarc]-NH2 (Example 225) 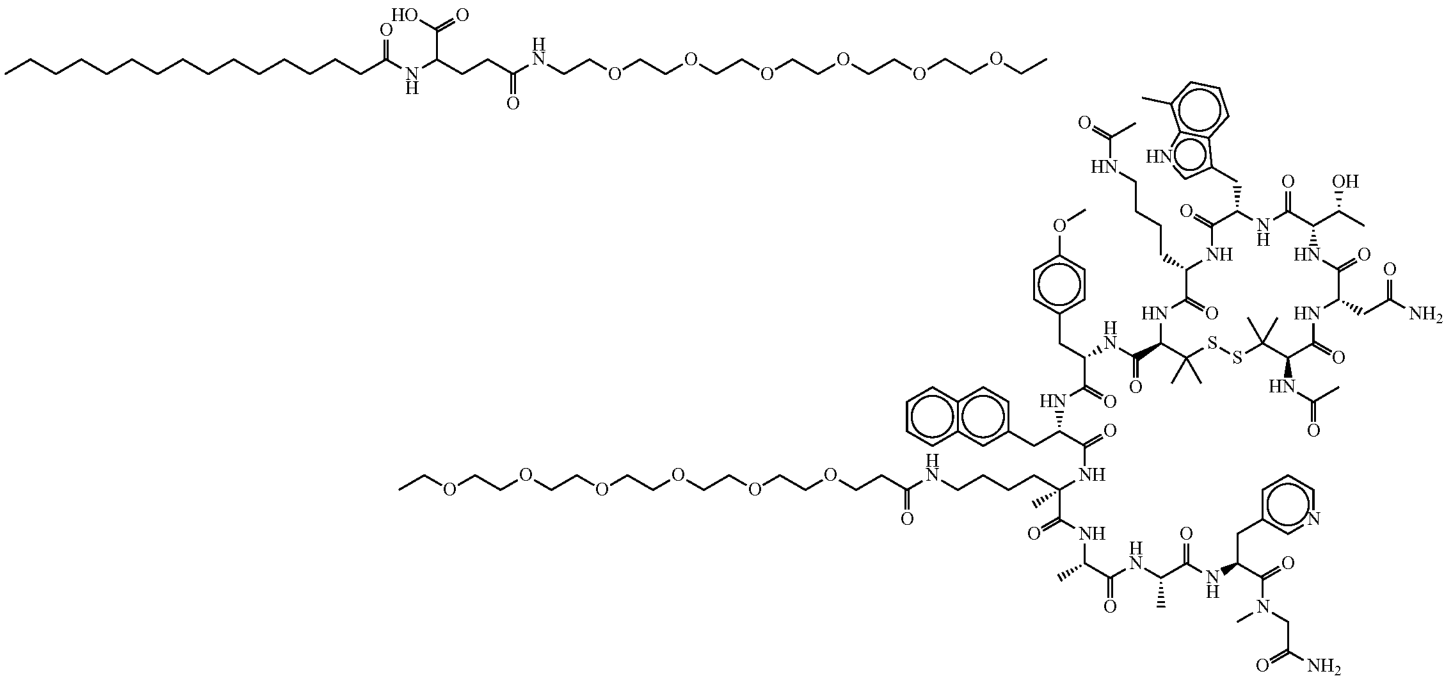 |

TABLE 1H
| Compounds. | |
|---|---|
| SEQ ID | Structure |
| 168 | Ac-[Pen]-A-T-[Trp(7-Me)]-[Lys(Ac)]-[Pen]-[Phe(4-OMe)]-[2Nal]-[aMeLys(PEG12_IsoGlu_Palm)]-[Lys(Ac)]-N-[3Pal]-[Sarc]-NH2 (Example 226)<br>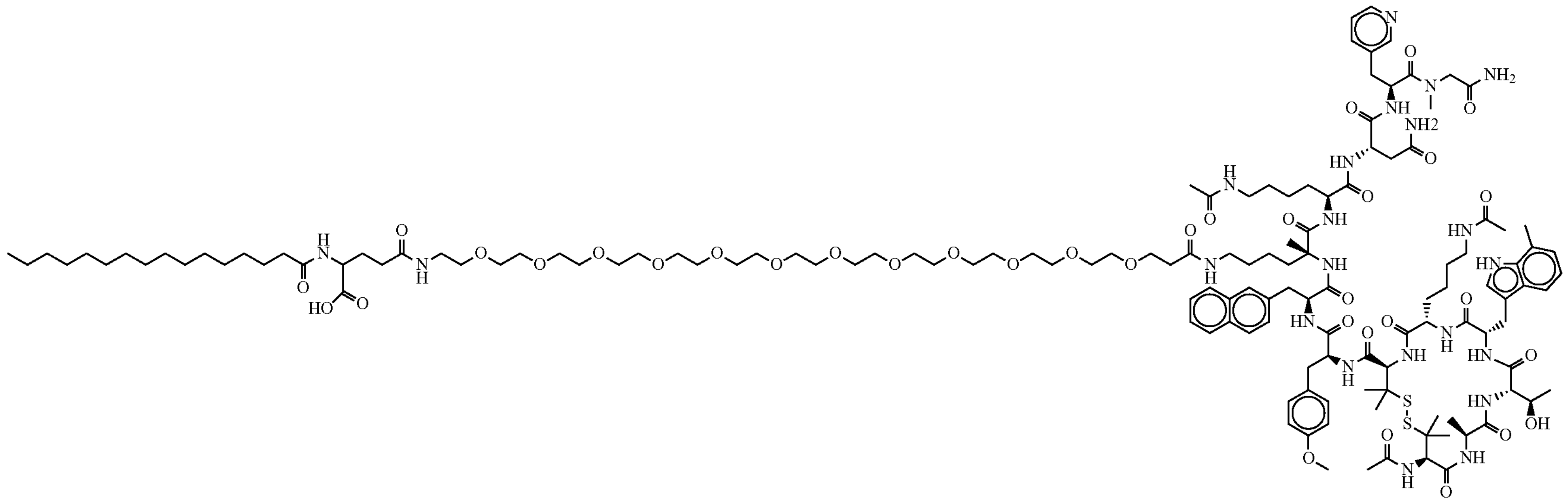 |

TABLE 1H-continued
| Compounds. | |
|---|---|
| SEQ ID | Structure |
| 169 | Ac-[Pen]-A-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-N-[3Pal]-[Sarc]-NH2 (Example 227) 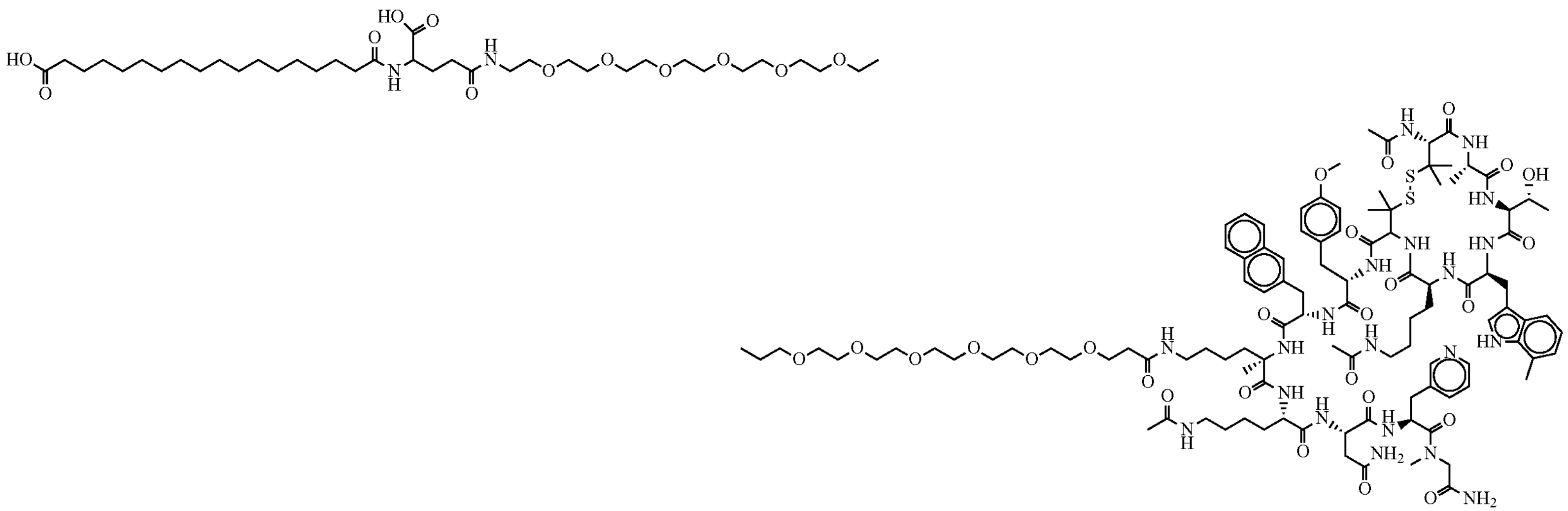 |

TABLE 1H-continued
| Compounds. | |
|---|---|
| SEQ ID | Structure |
| 170 | Ac-[Pen]-N-T-[Trp(7-Me)]-[Lys(Ac)]-[Pen]-[Phe(4-(2-(1PEG2_1PEG2_IsoGlu_Palm)aminoethoxy))]-[2Nal]-[THP]-[Lys(Ac)]-L-[3Pal]-[Sarc]-NH2 (Example 228) 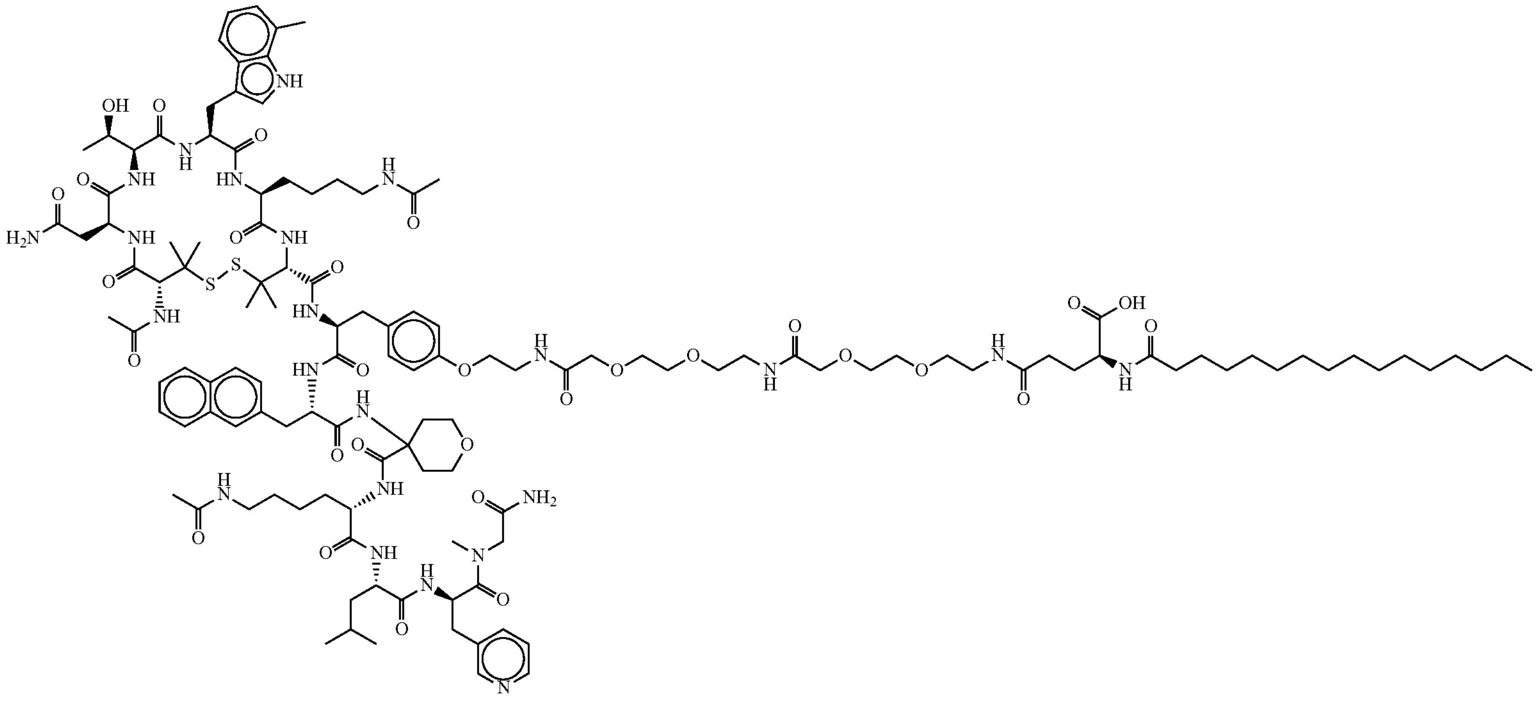 |

TABLE 1H-continued
Compounds.
| SEQ ID | Structure |
|---|---|
| 171 | Ac-[Pen]-N-T-[Trp(7-Me)]-[Lys(Ac)]-[Pen]-[Phe(4-(2-(1PEG2_1PEG2_IsoGlu_C18_Diacid)aminoethoxy))]-[2Nal]-[THP]-[Lys(Ac)]-L-[3Pal]-[Sarc]-NH2 (Example 229)<br>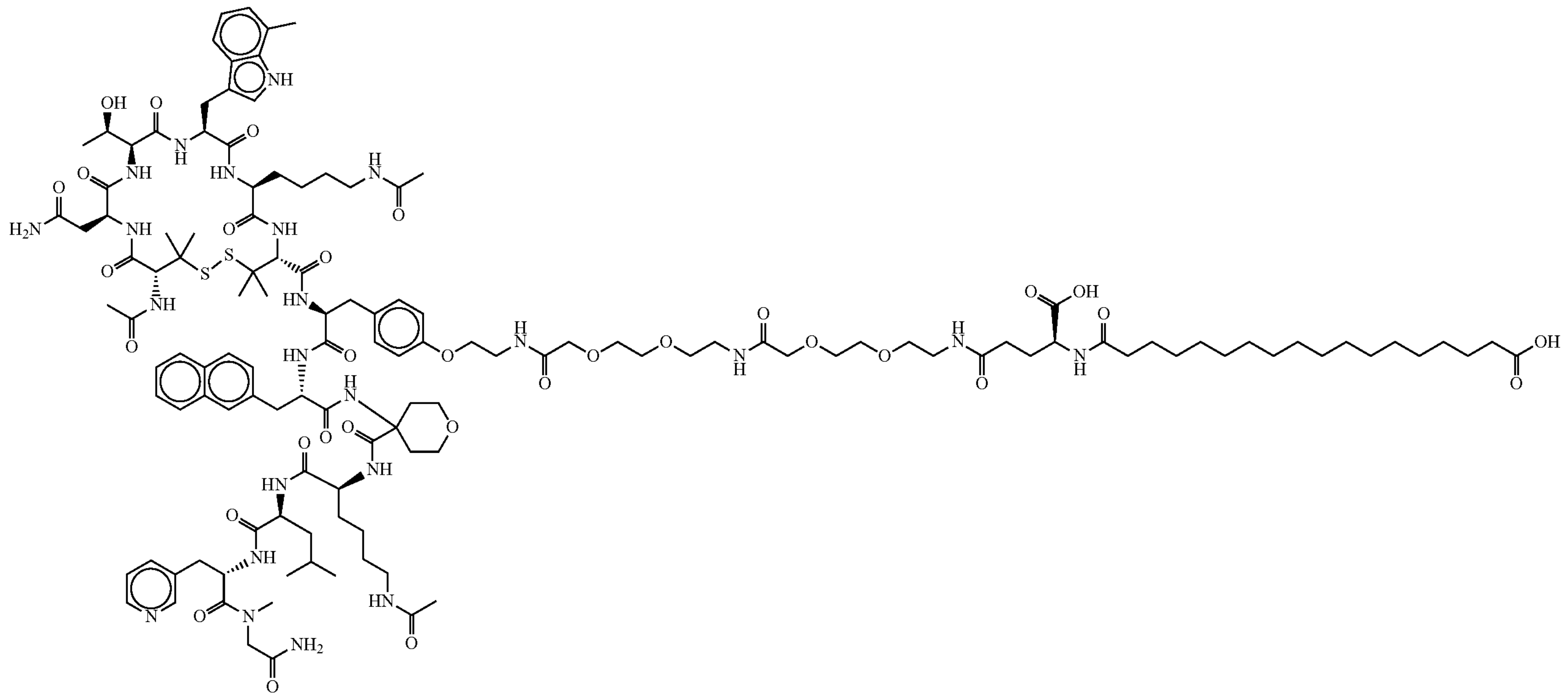 |

TABLE 1H-continued
| Compounds. | |
|---|---|
| SEQ ID | Structure |
| 172 | Ac-[Pen]-N-T-[Trp(7-Me)]-[Lys(Ac)]-[Pen]-[Phe(4-(2-(PEG4_PEG4_IsoGlu_Palm)aminoethoxy))]-[2Nal]-[THP]-[Lys(Ac)]-L-[3Pal]-[Sarc]-NH2 (Example 230) 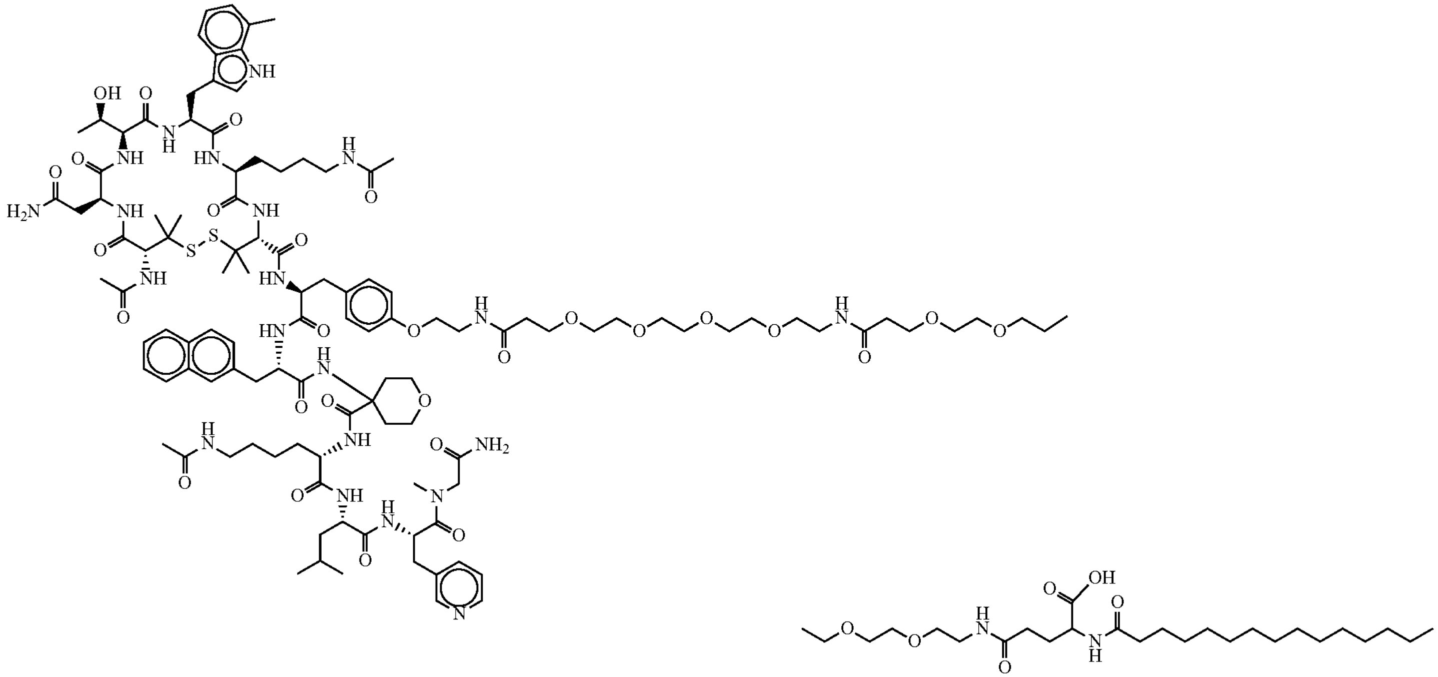 |

TABLE 1H-continued
| Compounds. | |
|---|---|
| SEQ ID | Structure |
| 173 | Ac-[Pen]-N-T-[Trp(7-Me)]-[Lys(Ac)]-[Pen]-[Phe(4-(2-(PEG12_IsoGlu_Palm)aminoethoxy))]-[2Nal]-[THP]-[Lys(Ac)]-L-[3Pal]-[Sarc]-NH2 (Example 231) 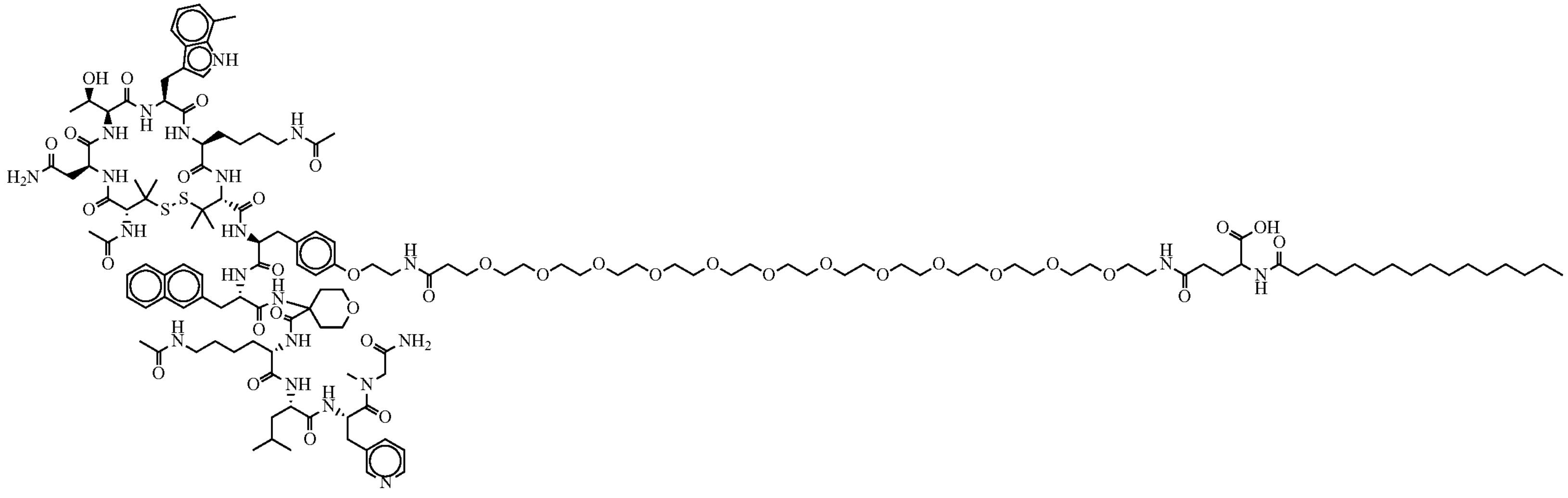 |

TABLE 1H-continued
| Compounds. | |
|---|---|
| SEQ ID | Structure |
| 174 | Ac-[Pen]-N-T-[Trp(7-Me)]-[Lys(Ac)]-[Pen]-[Phe(4-OMe)]-[2Nal]-[Lys(PEG12_IsoGlu_Palm)]-[Lys(Ac)]-N-[3Pal]-[Sarc]-NH2 (Example 232) 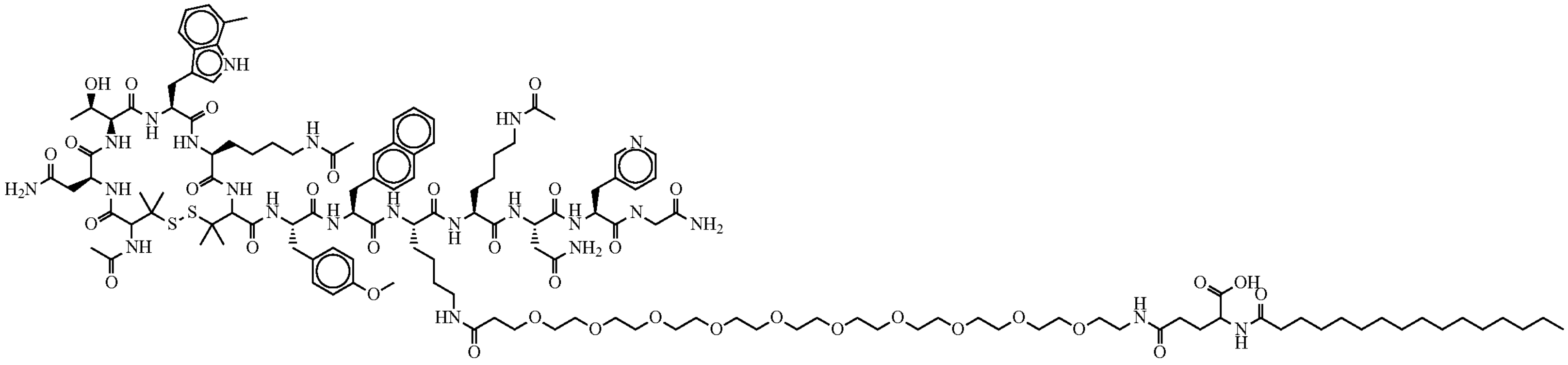 |
| 175 | Ac-[Pen]-N-T-[Trp(7-Me)]-[Lys(Ac)]-[Pen]-F-[2Nal]-[Spiral_Pip_PEG12_IsoGlu_Palm]-[Lys(Ac)]-N-[3Pal]-[Sarc]-NH2 (Example 233) 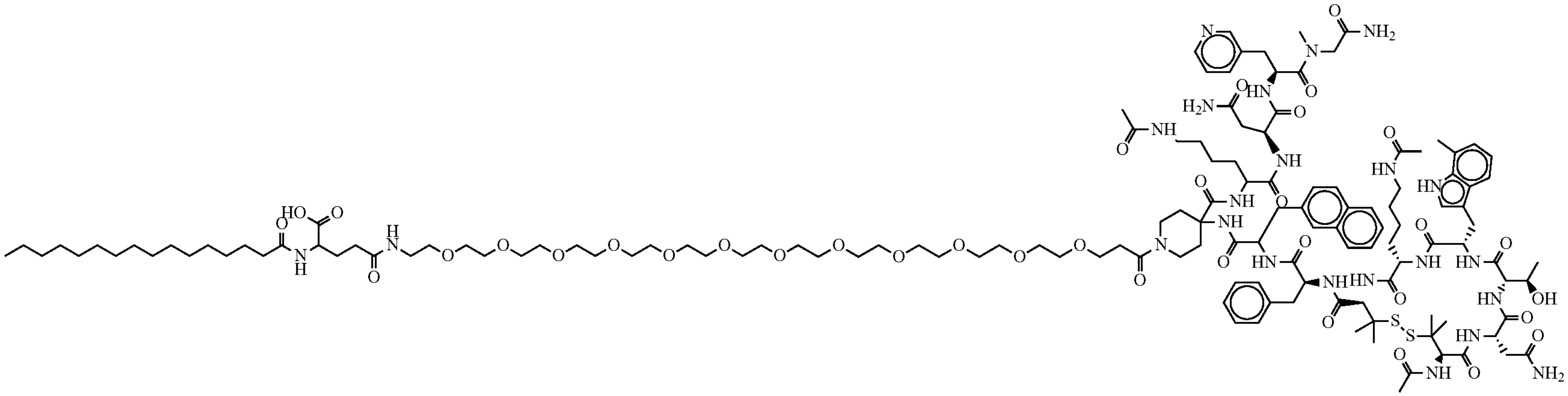 |

TABLE 1H-continued
| Compounds. | |
|---|---|
| SEQ ID | Structure |
| 176 | Ac-[Pen]-N-T-[Trp(7-Me)]-[Lys(Ac)]-[Pen]-F-[2Nal]-[aMeLys(PEG12_IsoGlu_Palm)]-[Lys(Ac)]-L-[3Pal]-[Sarc]-NH2 (Example 234) 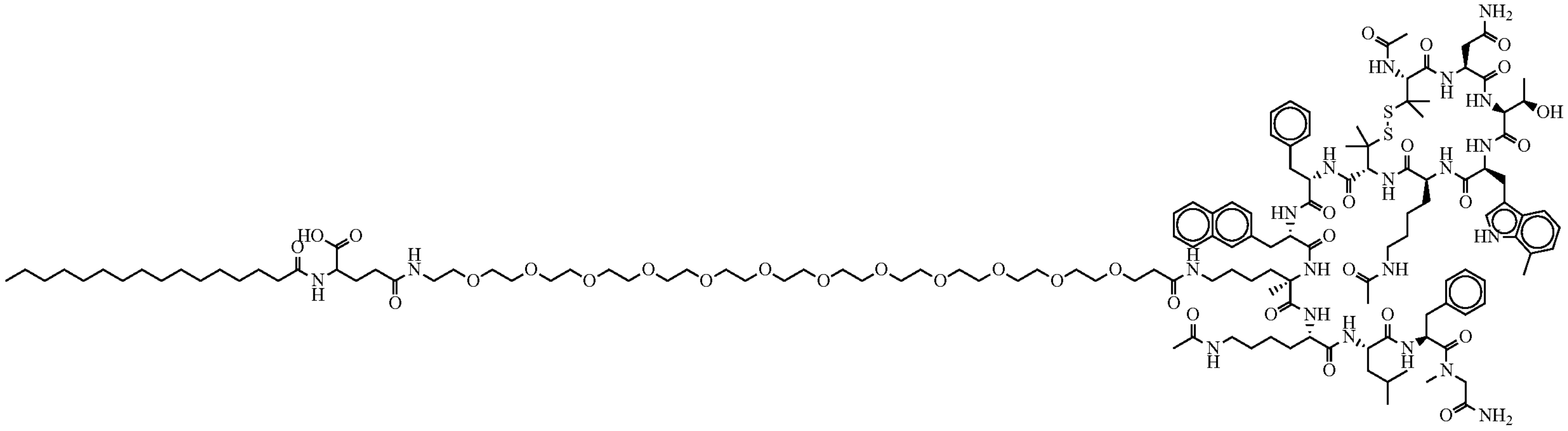 |
| 177 | Ac-[Pen]-N-T-[Trp(7-Me)]-[Lys(Ac)]-[Pen]-[Phe(4-OMe)]-[2Nal]-[aMeLys(PEG12_IsoGlu_C18_Diacid)]-A-A-[3Pal]-[Sarc]-NH2 (Example 235) 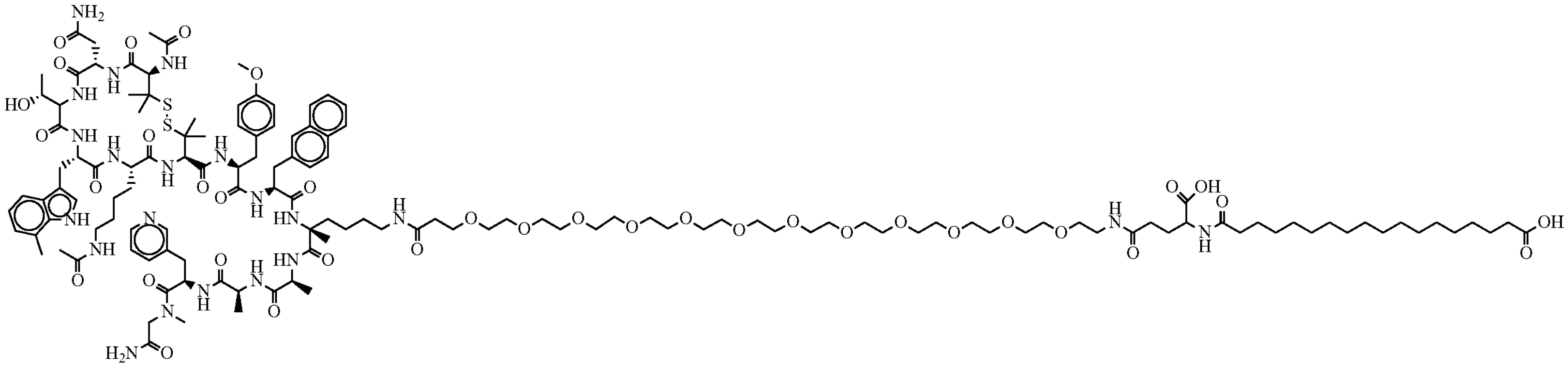 |

TABLE 1H-continued
| Compounds. | |
|---|---|
| SEQ ID | Structure |
| 178 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12_C18_Diacid)]-NH2 (Example 236) 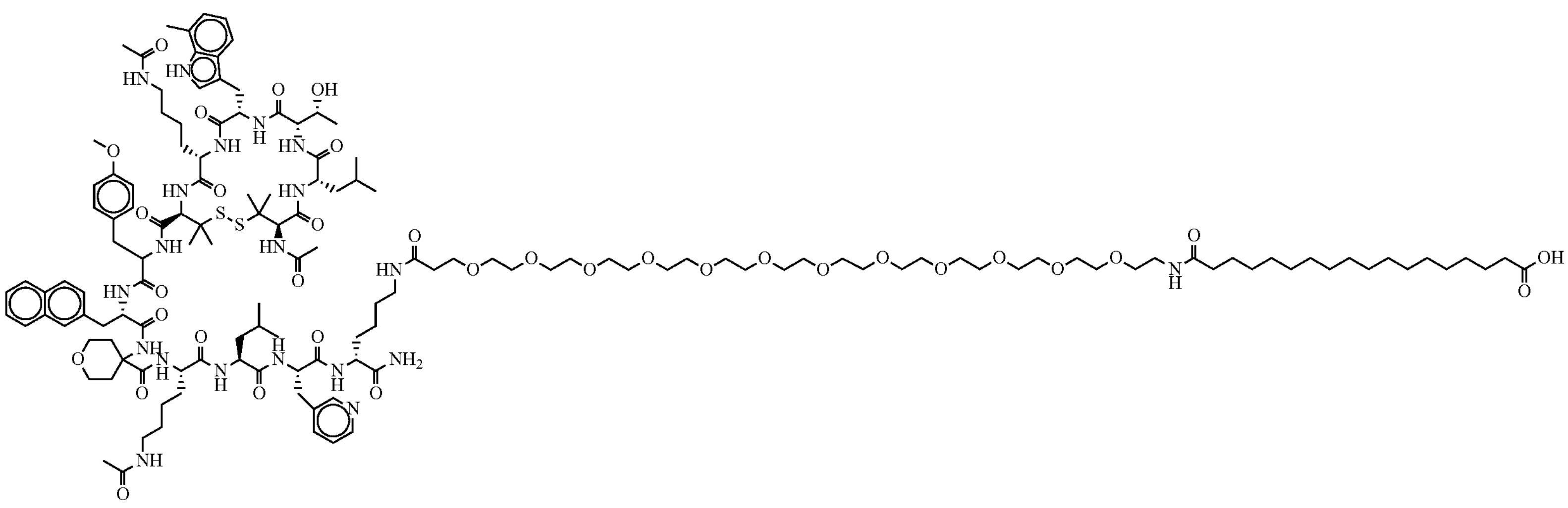 |

TABLE 1H-continued
| Compounds. | |
|---|---|
| SEQ ID | Structure |
| 179 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12_IsoGlu_Palm)]-NH2 (Example 237) 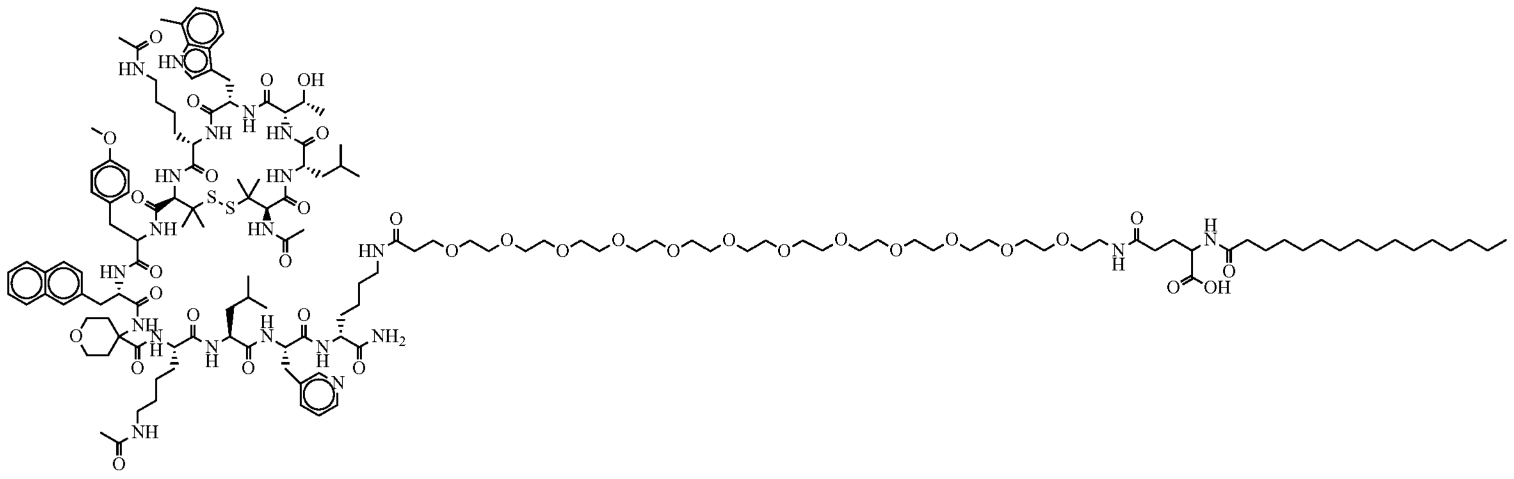 |

TABLE 1H-continued
| Compounds. | |
|---|---|
| SEQ ID | Structure |
| 180 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12_IsoGlu_C18_Diacid)]-NH2 (Example 238) 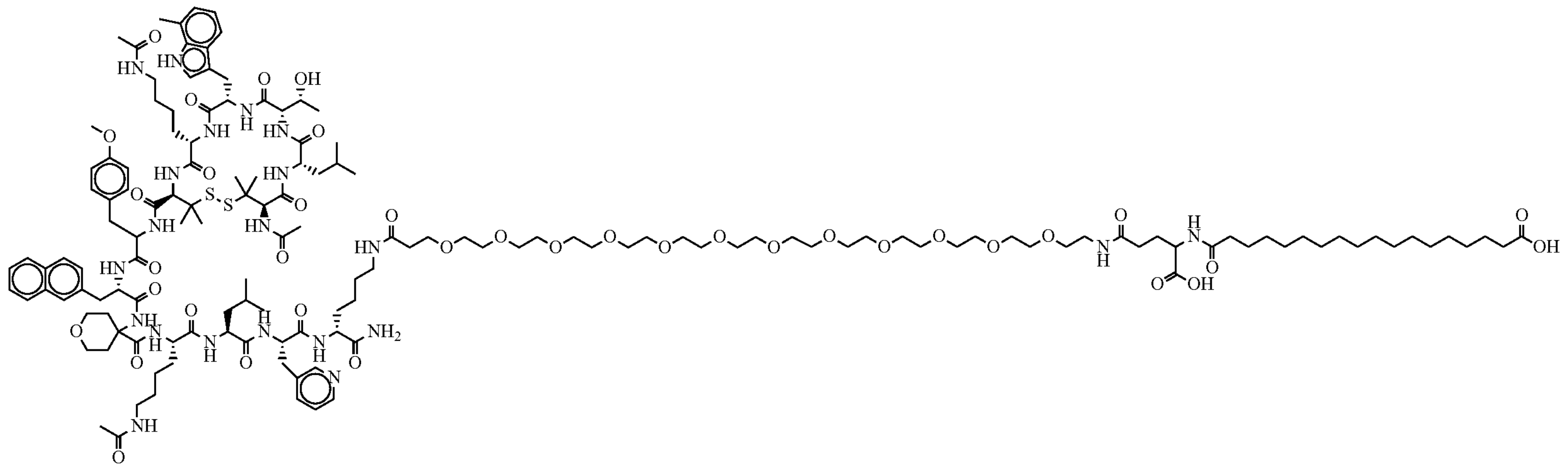 |

TABLE 1H-continued
| Compounds. | |
| --- | --- |
| SEQ ID | Structure |
| 181 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12_C18_Diacid)]-[3Pal]-[Sarc]-NH2 (Example 239) 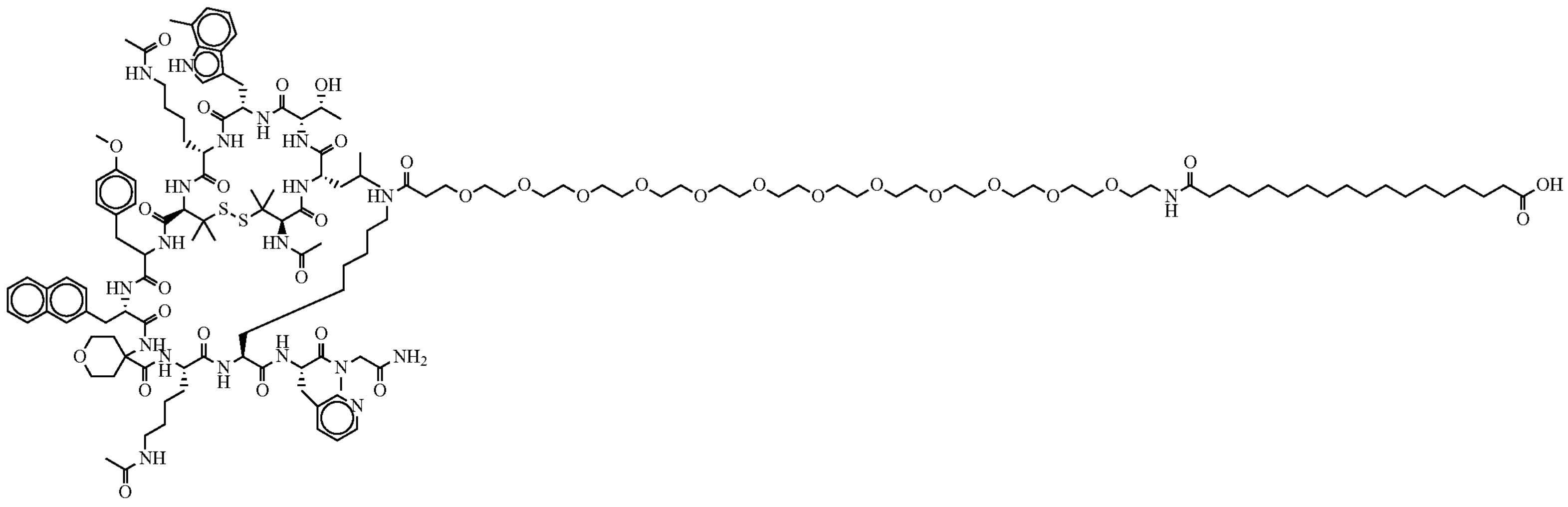 |

TABLE 1H-continued
| Compounds. | |
|---|---|
| SEQ ID | Structure |
| 182 | Ac-[Pen]-A-T-[Trp(7-Me)]-[Lys(Ac)]-[Pen]-[Phe(4-OMe)]-[2Nal]-[aMeLys(PEG12_IsoGlu_Palm)]-[Lys(Ac)]-A-[3Pal]-[Sarc]-NH2 (Example 240) 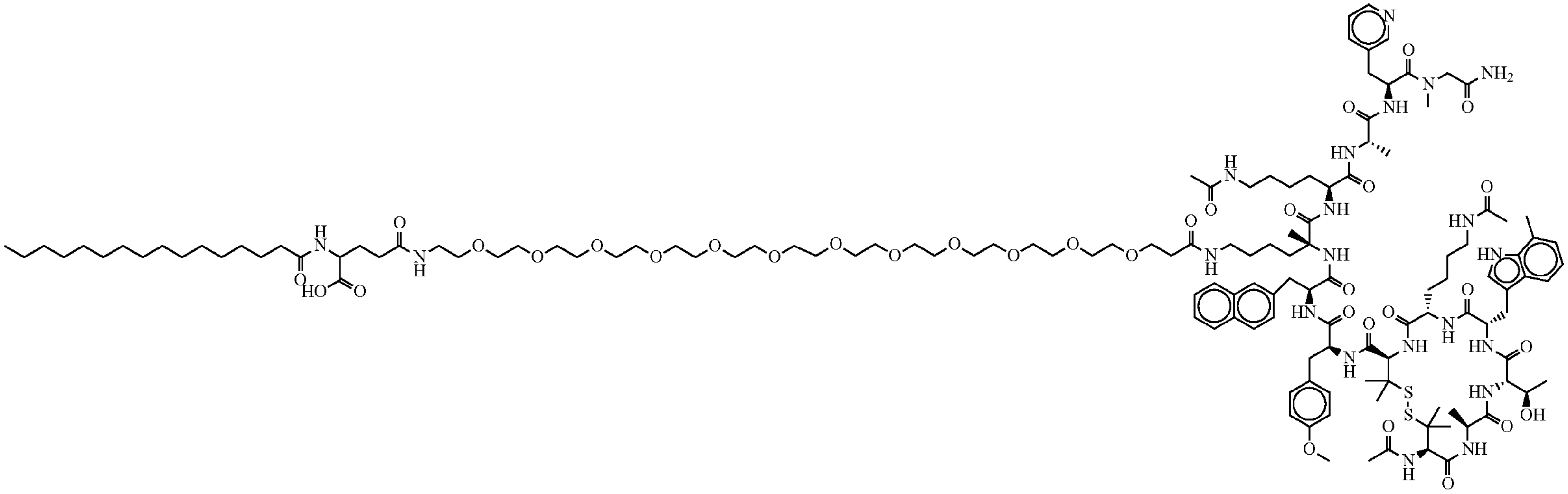 |

TABLE 1H-continued
| Compounds. | |
|---|---|
| SEQ ID | Structure |
| 183 | Ac-[Pen]-A-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-A-[3Pal]-[Sarc]-NH2 (Example 241) 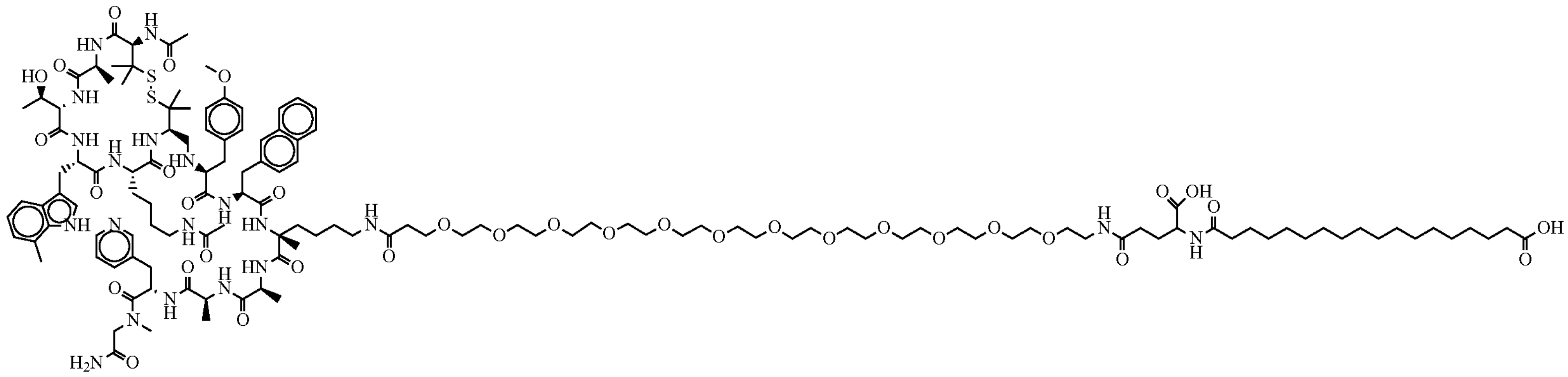 |

TABLE 1H-continued
| Compounds. | |
|---|---|
| SEQ ID | Structure |
| 184 | Ac-[Pen]-L-T-[Trp(7-Me)]-[Lys(Ac)]-[Pen]-[Phe(4-OMe)]-[2Nal]-[THP]-[Lys(PEG12_C18_Diacid)]-L-[3Pal]-[Sarc]-NH2 (Example 242)<br>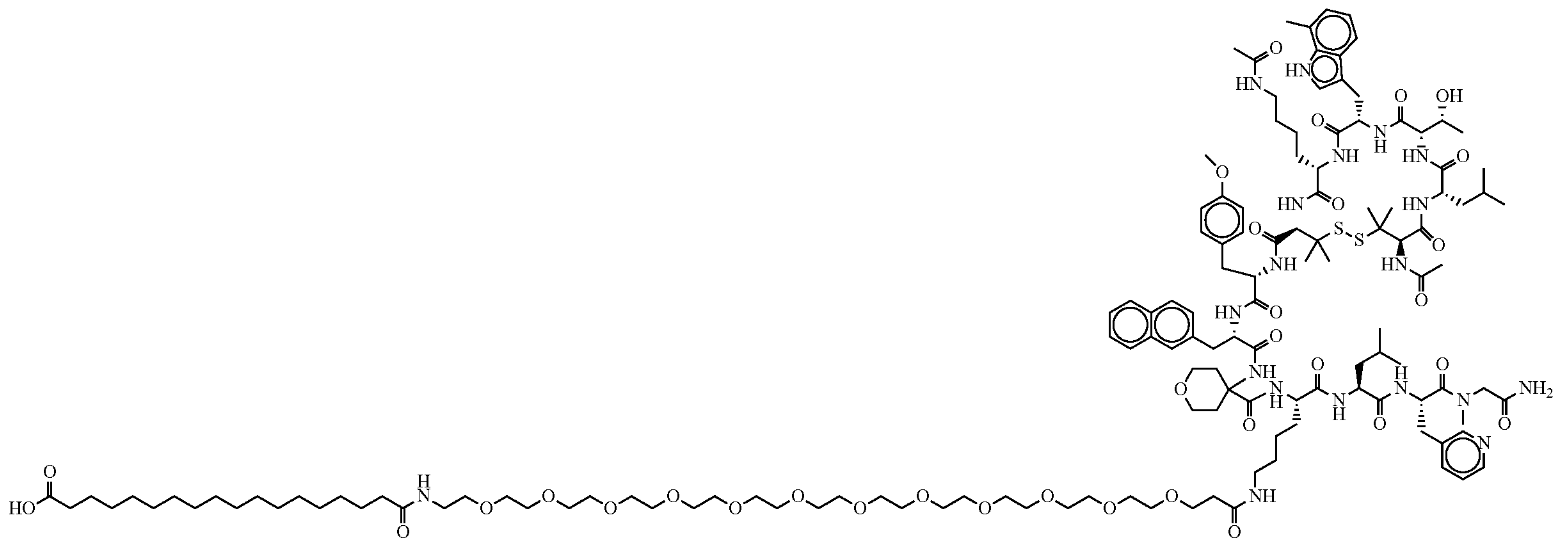 |

TABLE 1H-continued
| Compounds. | |
|---|---|
| SEQ ID | Structure |
| 185 | Ac-[Pen]-L-T-[Trp(7-Me)]-[Lys(Ac)]-[Pen]-[Phe(4-OMe)]-[2Nal]-[THP]-[Lys(PEG12_IsoGlu_Palm)]-L-[3Pal]-[Sarc]-NH2 (Example 243) 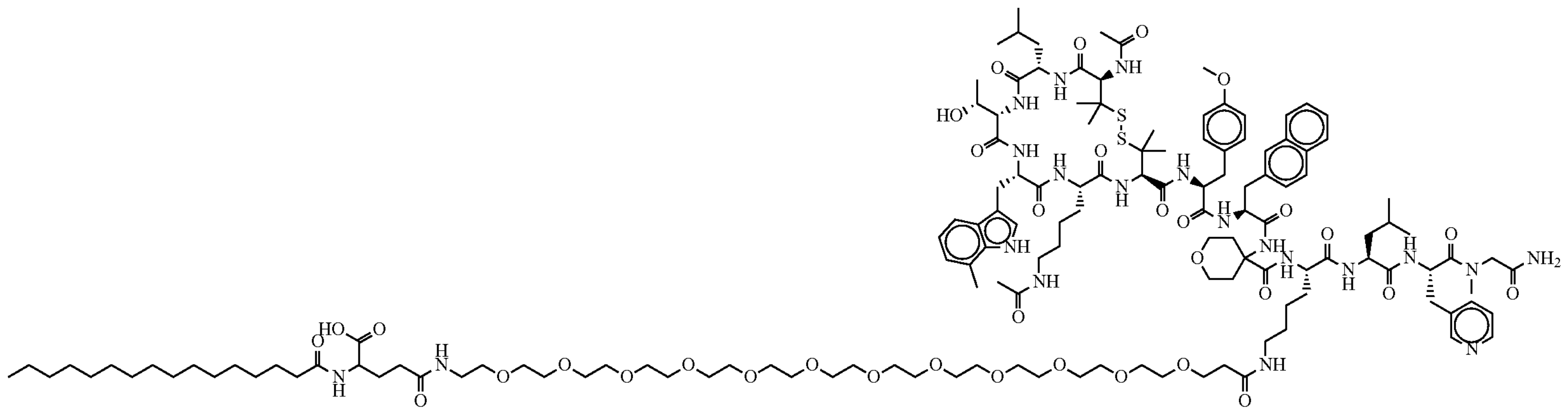 |

TABLE 1H-continued
Compounds.
| SEQ ID | Structure |
|---|---|
| 186 | Ac-[Pen]-L-T-[Trp(7-Me)]-[Lys(Ac)]-[Pen]-[Phe(4-OMe)]-[2Nal]-[THP]-[Lys(PEG12_IsoGlu_C18_Diacid)]-L-[3Pal]-[Sarc]-NH2 (Example 244) 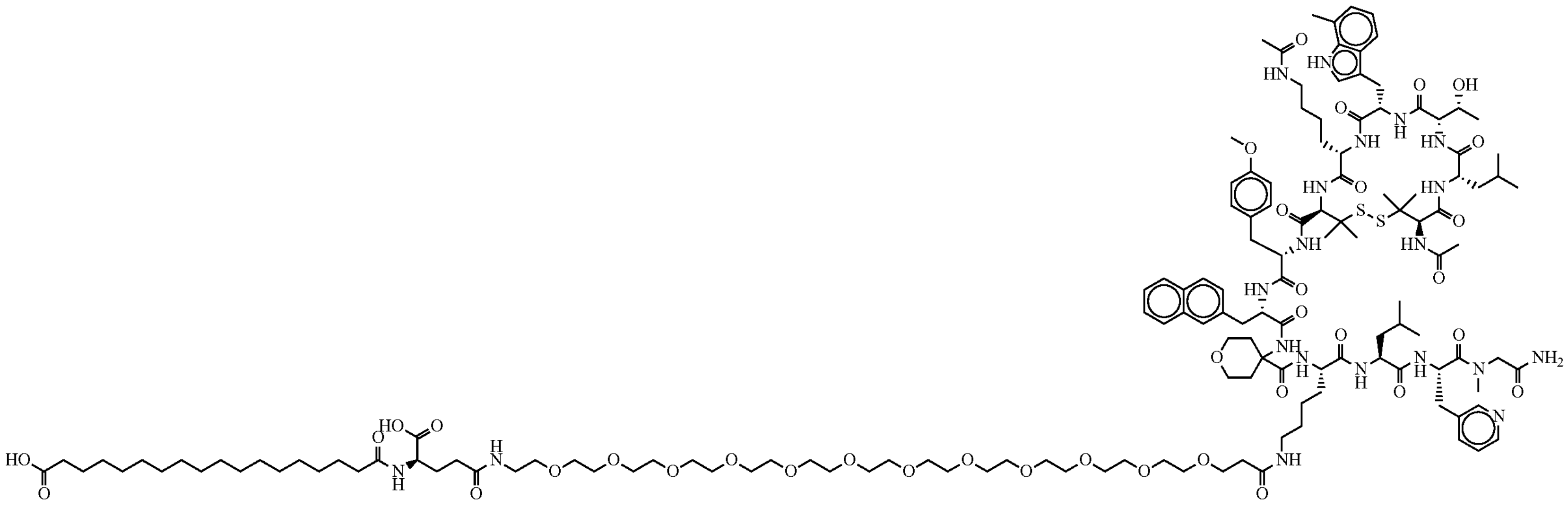 |

TABLE 1H-continued
| Compounds. | |
|---|---|
| SEQ ID | Structure |
| 187 | Ac-[Pen]-L-[Lys(PEG12_C18_Diacid)]-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 245) 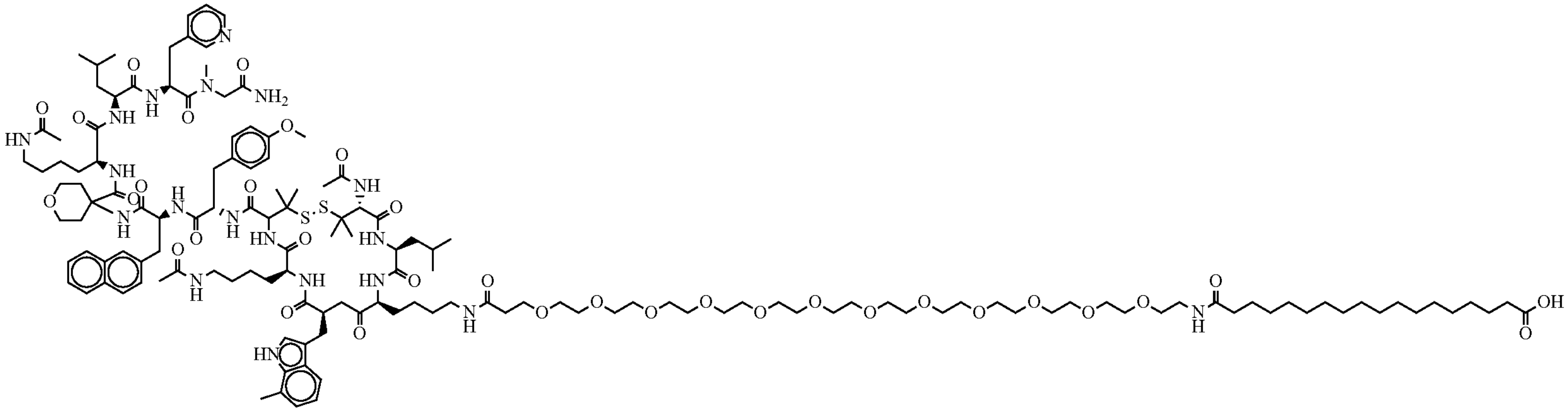 |

TABLE 1H-continued
| Compounds. | |
|---|---|
| SEQ ID | Structure |
| 188 | Ac-[Pen]-L-[Lys(PEG12_IsoGlu_Palm)]-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 246) 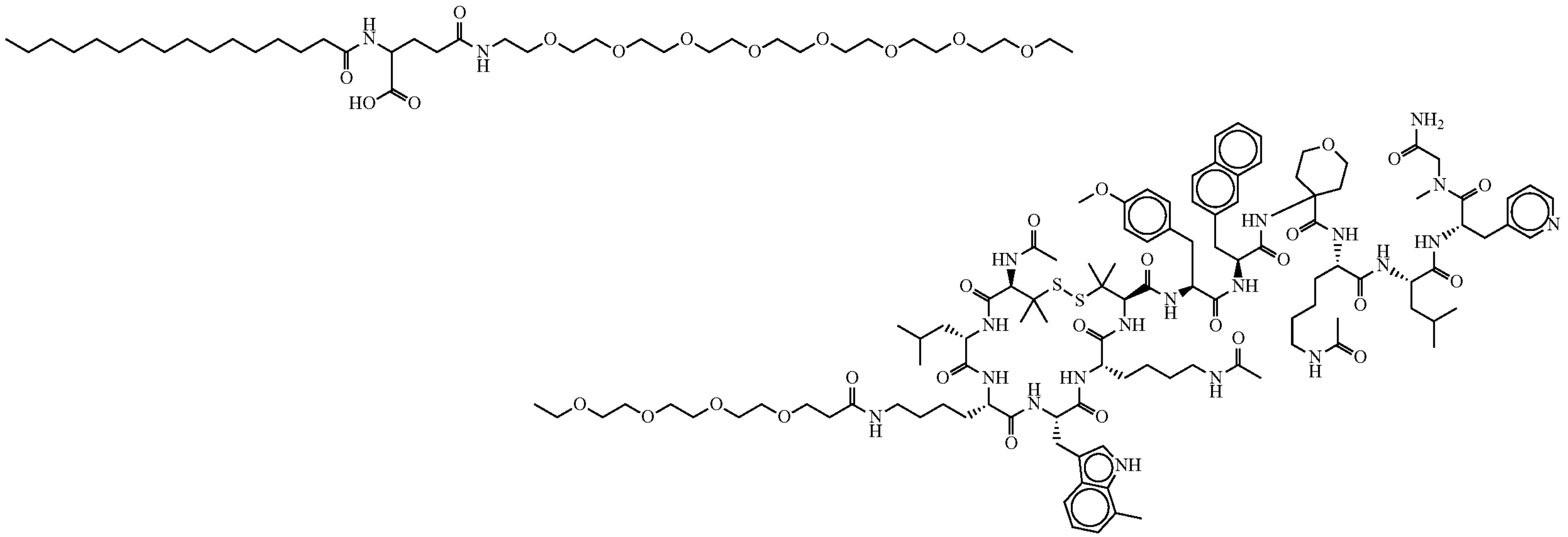 |

TABLE 1H-continued
| Compounds. | |
|---|---|
| SEQ ID | Structure |
| 189 | Ac-[Pen]-L-[Lys(PEG12_IsoGlu_C18_Diacid)]-[Trp(7-Me)]-[Lys(Ac)]-[Pen]-[Phe(4-OMe)]-[2Nal]-[THP]-[Lys(Ac)]-L-[3Pal]-[Sarc]-NH2<br>(Example 247)<br>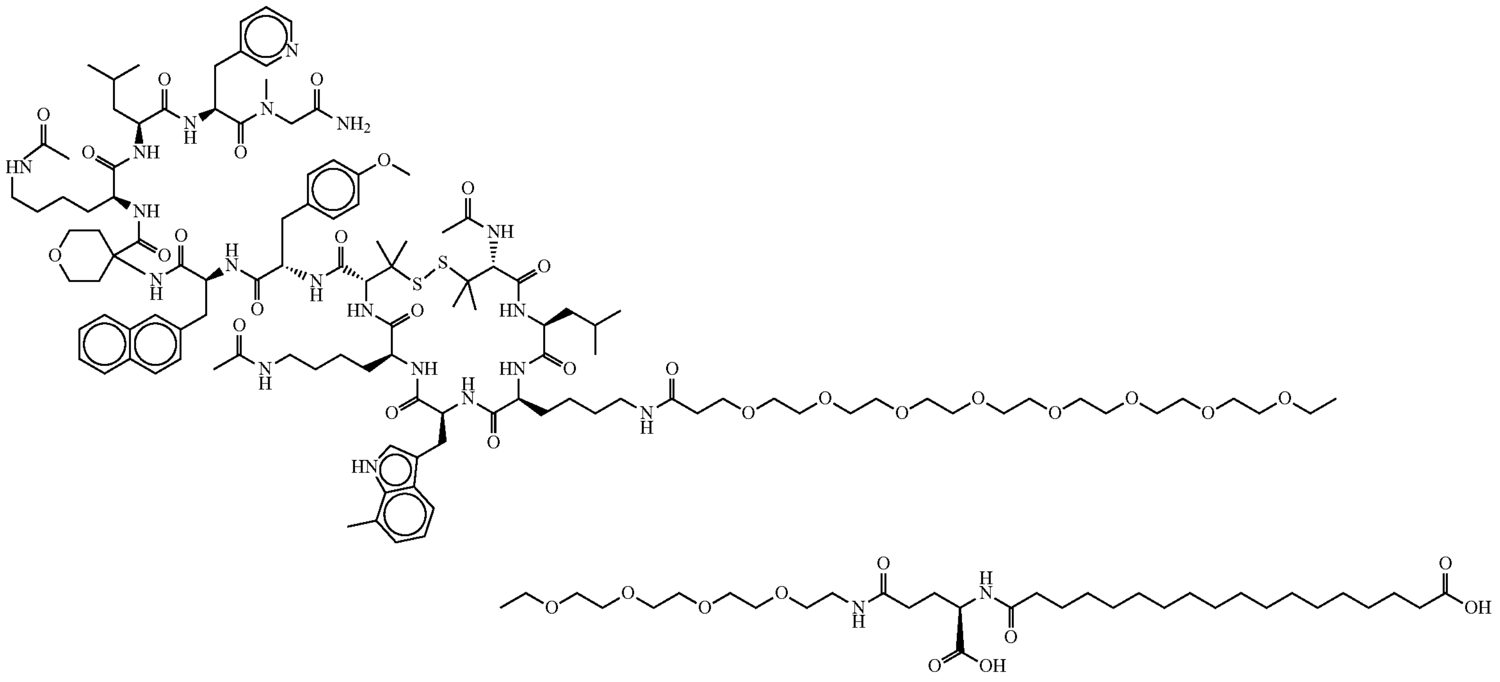 |

TABLE 1H-continued
| Compounds. | |
|---|---|
| SEQ ID | Structure |
| 190 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-[Lys(Ac)]-A-[3Pal]-[Sarc]-NH2 (Example 248) 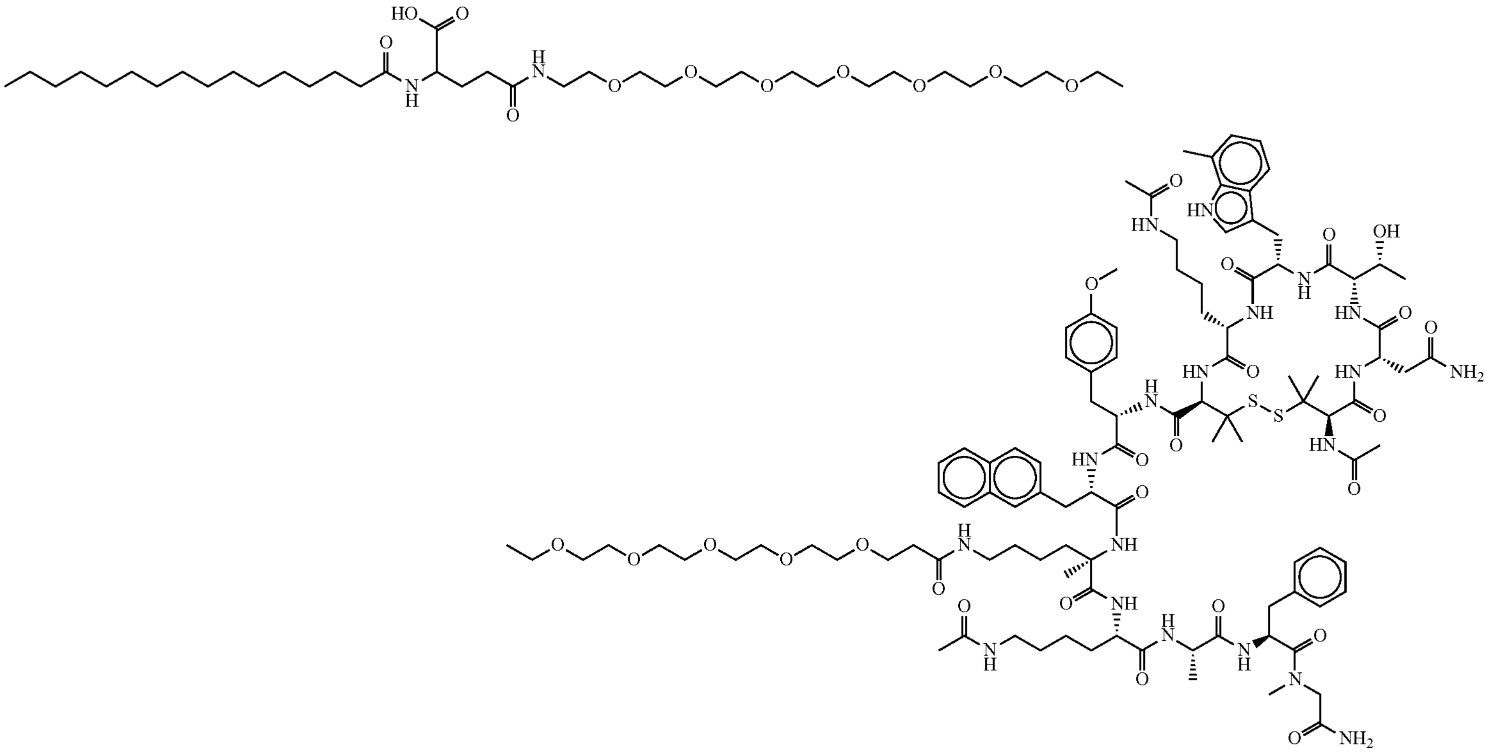 |

TABLE 1H-continued
| Compounds. | |
|---|---|
| SEQ ID | Structure |
| 191 | Ac-[Pen]-[Lys(PEG12_IsoGlu_Palm)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 249) 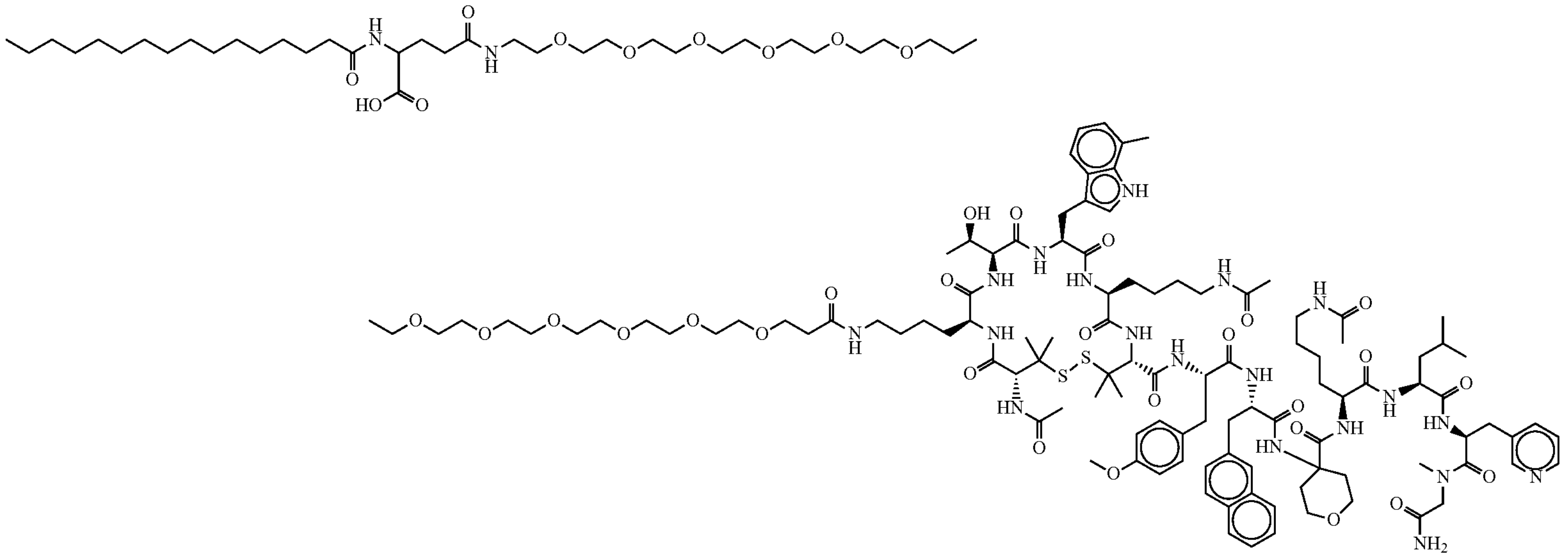 |

TABLE 1H-continued
| Compounds. | |
|---|---|
| SEQ ID | Structure |
| 192 | Ac-[Pen]-[Lys(PEG12_IsoGlu_C18_Diacid)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 250) 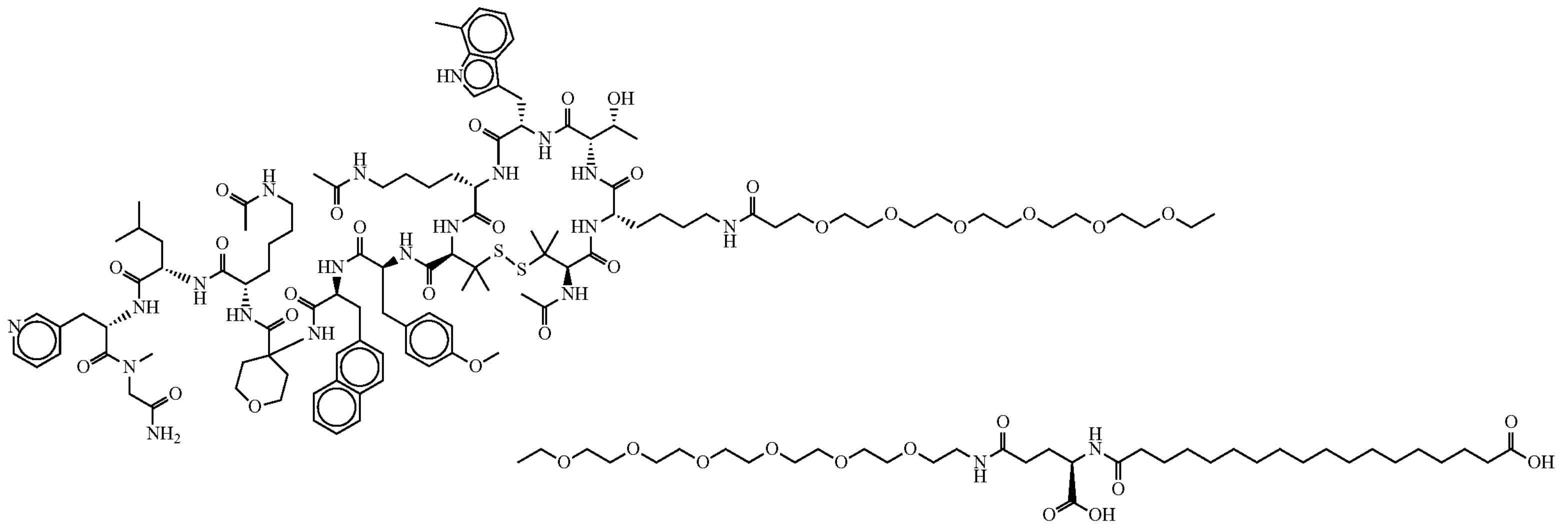 |

TABLE 1I
| Compounds. | |
|---|---|
| SEQ ID. | Structure |
| 193 | [Pen(PEG4_Ahx_C18_Diacid)]-N-T-[Trp(7-Me)]-[Lys(Ac)]-[Pen]-[Phe(4-OMe)]-[2Nal]-[THP]-E-L-[3Pal]-[Sarc]-NH2 (Example 251) 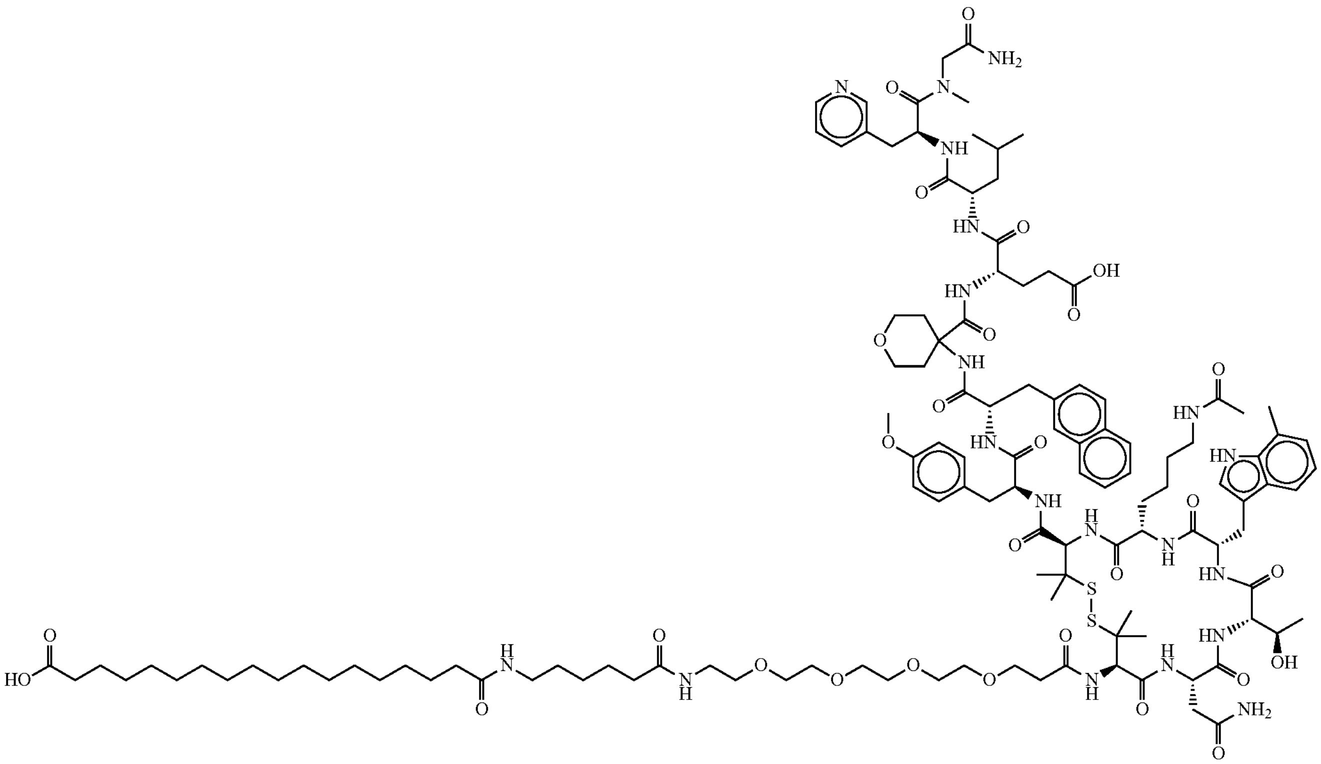 |

TABLE 1I-continued
| Compounds. | |
|---|---|
| SEQ ID. | Structure |
| 194 | [Pen(PEG4_IsoGlu_C18_Diacid)]-N-T-[Trp(7-Me)]-[Lys(Ac)]-[Pen]-[Phe(4-OMe)]-[2Nal]-[THP]-E-L-[3Pal]-[Sarc]-NH2<br>(Example 252)<br>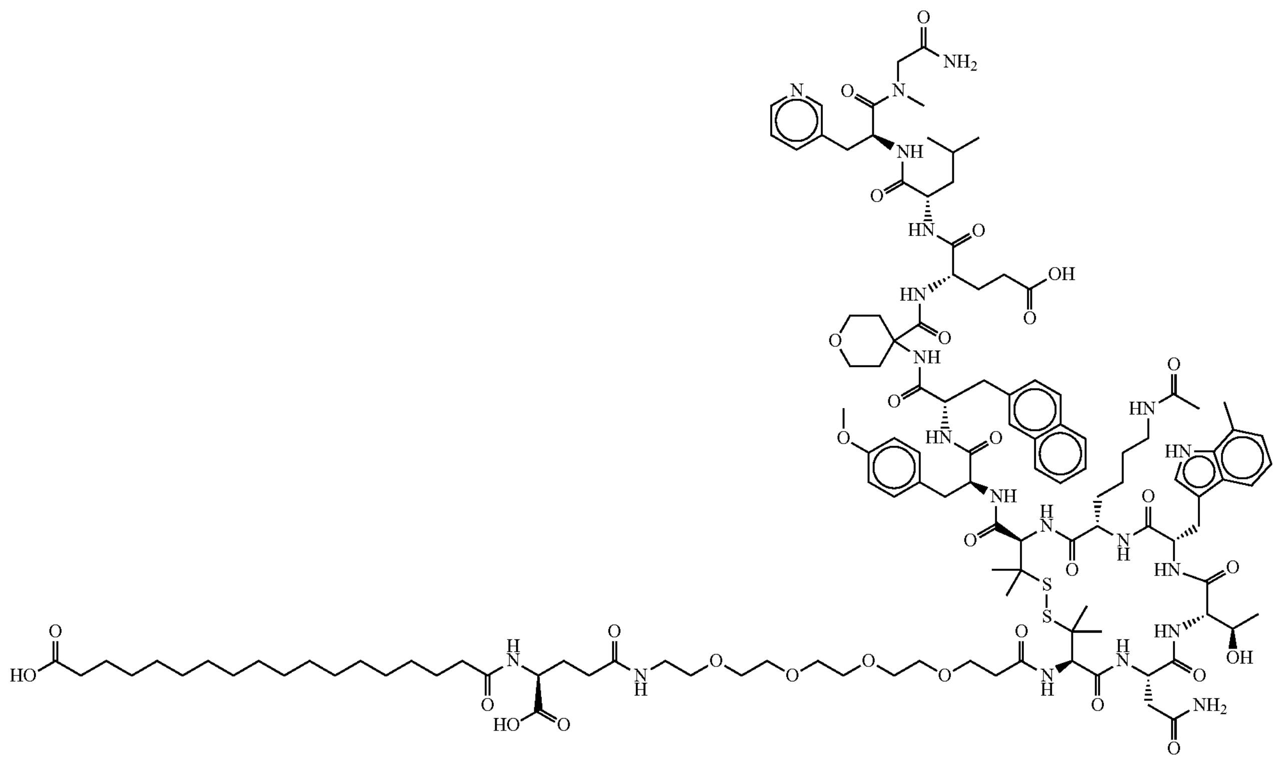 |

TABLE 1I-continued
| Compounds. | |
|---|---|
| SEQ ID. | Structure |
| 195 | Ac-[(D)Lys(PEG12_IsoGlu_Palm)]-[Pen]-L-T-[Trp(7-Me)]-[Lys(Ac)]-[Pen]-[Phe(4-OMe)]-[2Nal]-[THP]-L-L-[3Pal]-[Sarc]-NH2 (Example 253) 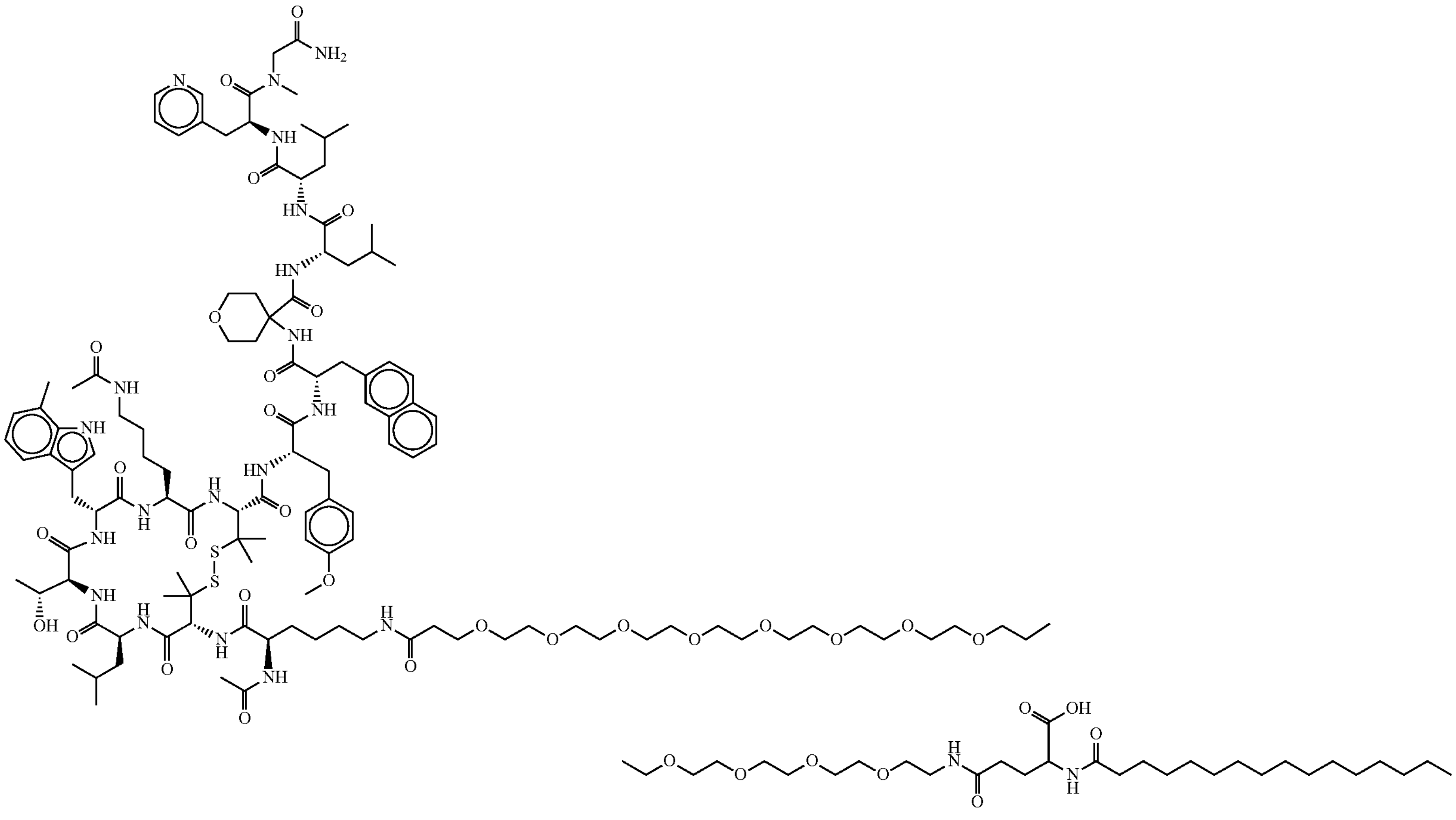 |

TABLE 1I-continued
| Compounds. | |
| --- | --- |
| SEQ ID. | Structure |
| 196 | Ac-[(D)Lys(PEG12_IsoGlu_C18_Diacid)]-[Pen]-L-T-[Trp(7-Me)]-[Lys(Ac)]-[Pen]-[Phe(4-OMe)]-[2Nal]-[THP]-L-L-[3Pal]-[Sarc]-NH2<br>(Example 254)<br>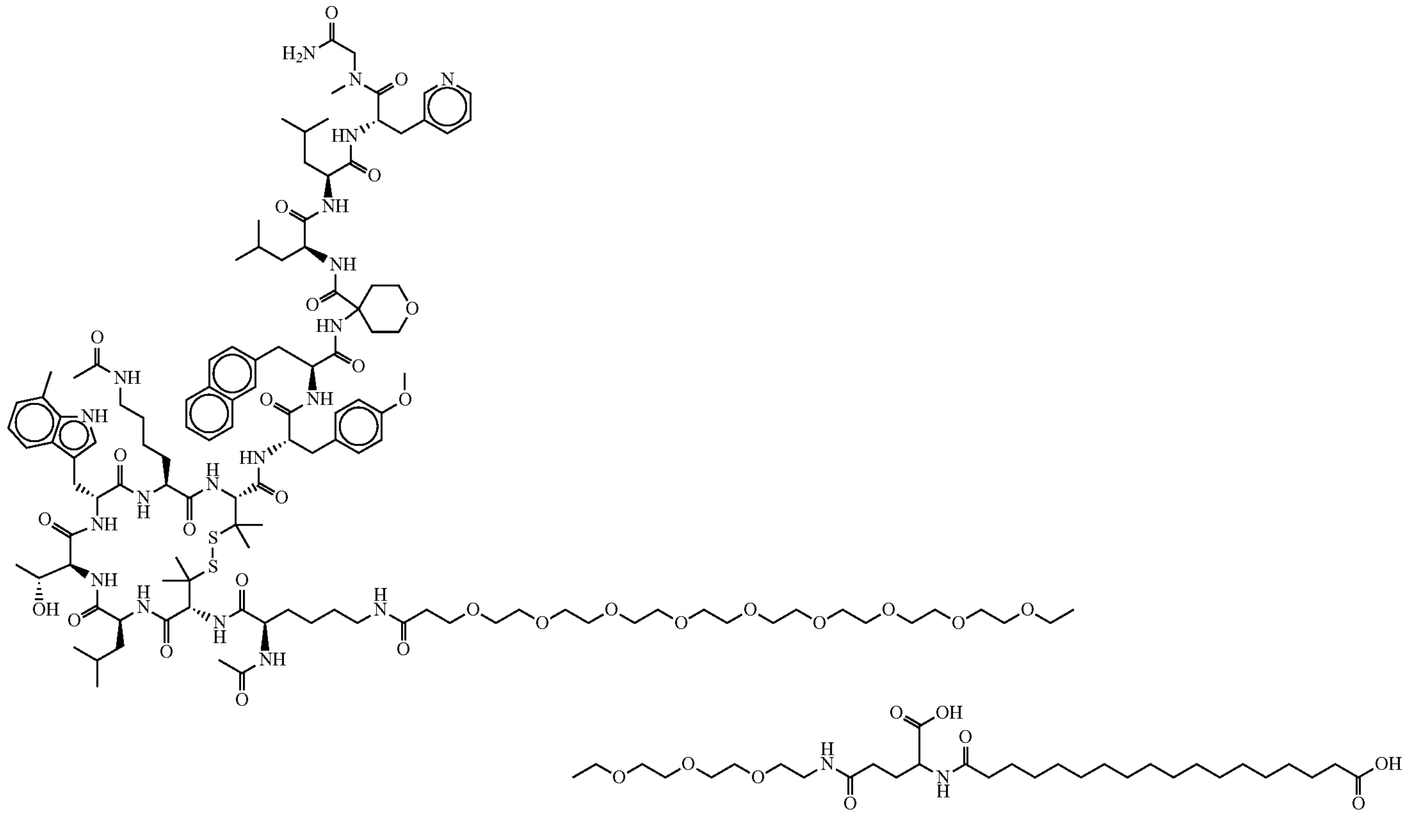 |

TABLE 1I-continued
| Compounds. | |
|---|---|
| SEQ ID. | Structure |
| 197 | Ac-[(D)Lys(PEG12_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 255) 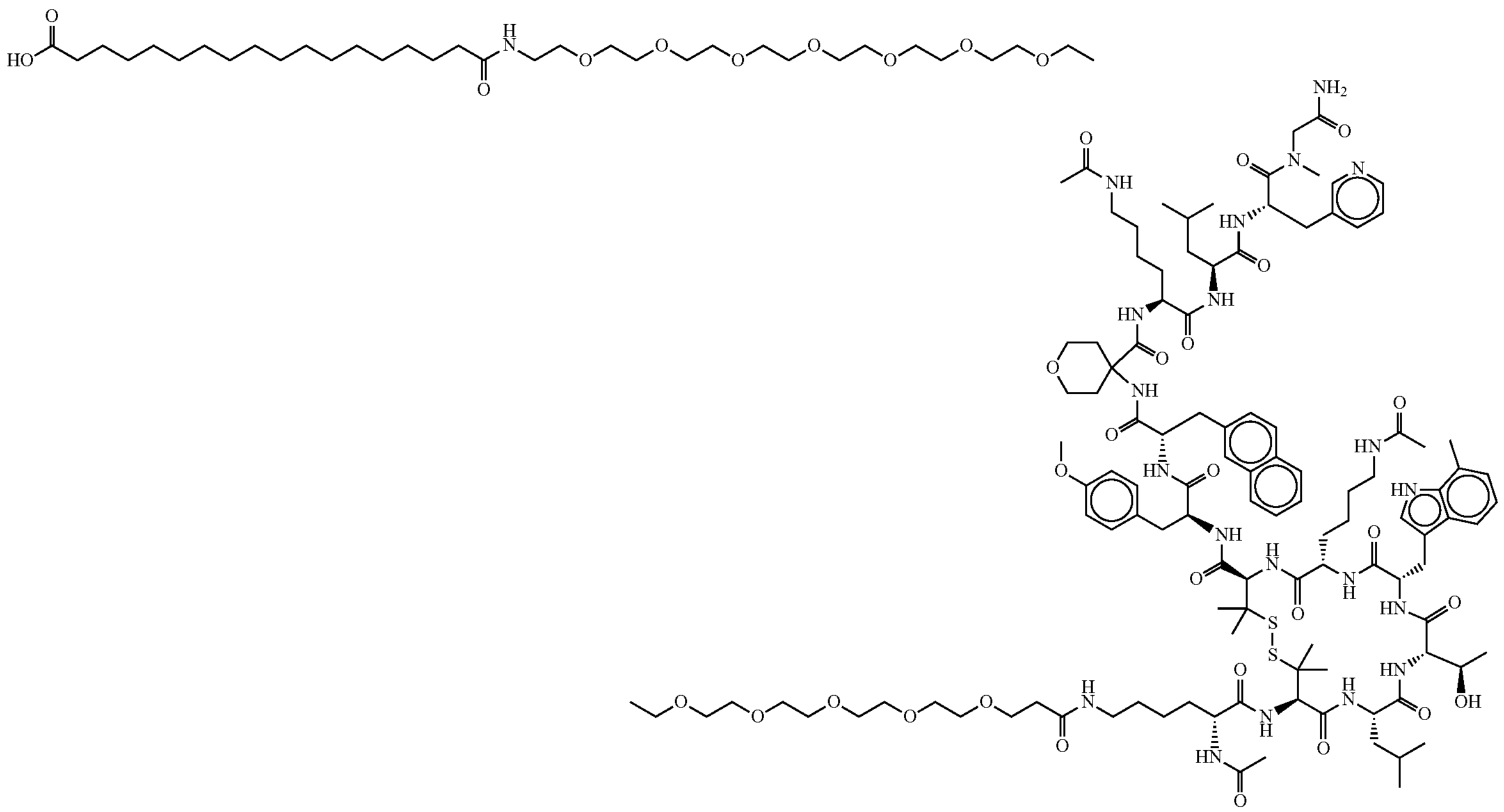 |

TABLE 1I-continued
| SEQ ID. | Compounds. Structure |
|---|---|
| 198 | Ac-[(D)Lys(Peg4_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 256) 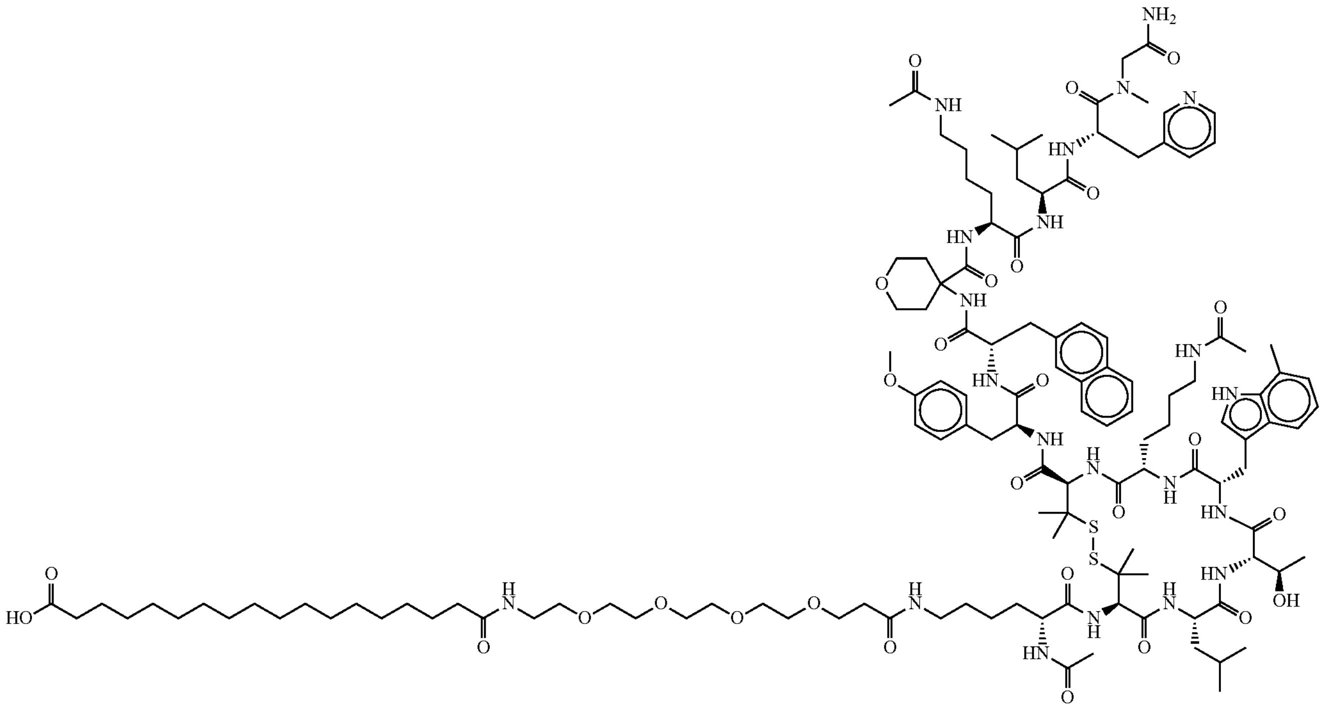 |

TABLE 1I-continued
| Compounds. | |
|---|---|
| SEQ ID. | Structure |
| 199 | Ac-[(D)Lys(IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 257) 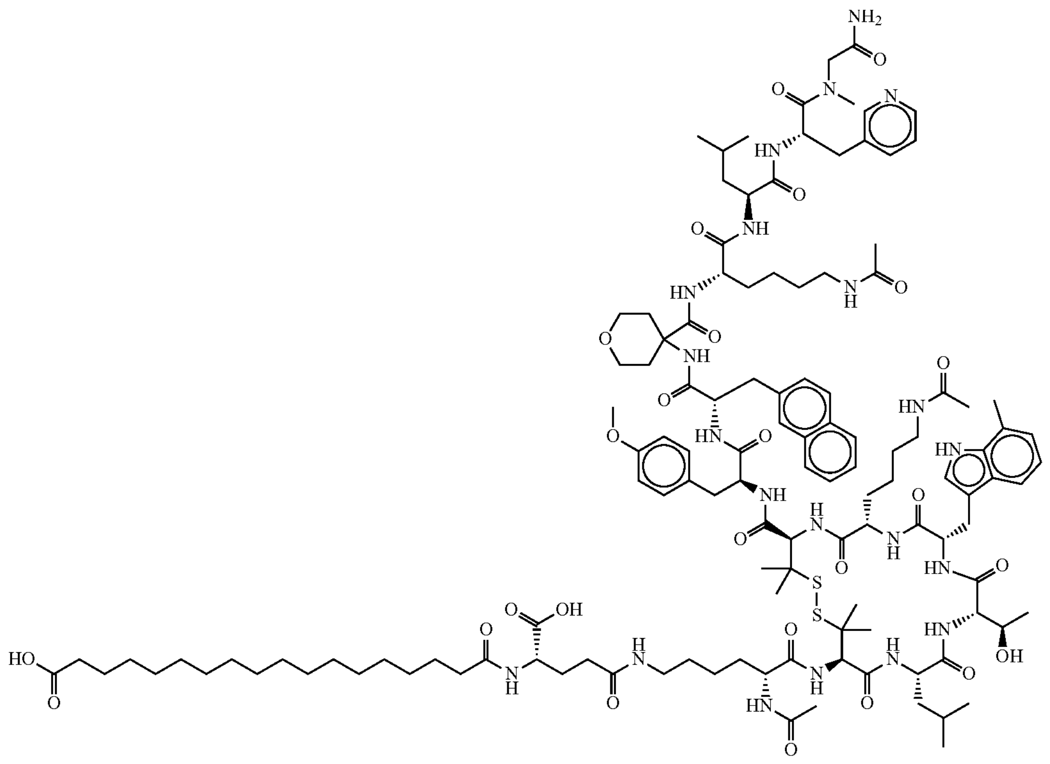 |

TABLE 1I-continued
| Compounds. | |
| --- | --- |
| SEQ ID. | Structure |
| 200 | Ac-[(D)Lys(Peg4_IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 258) 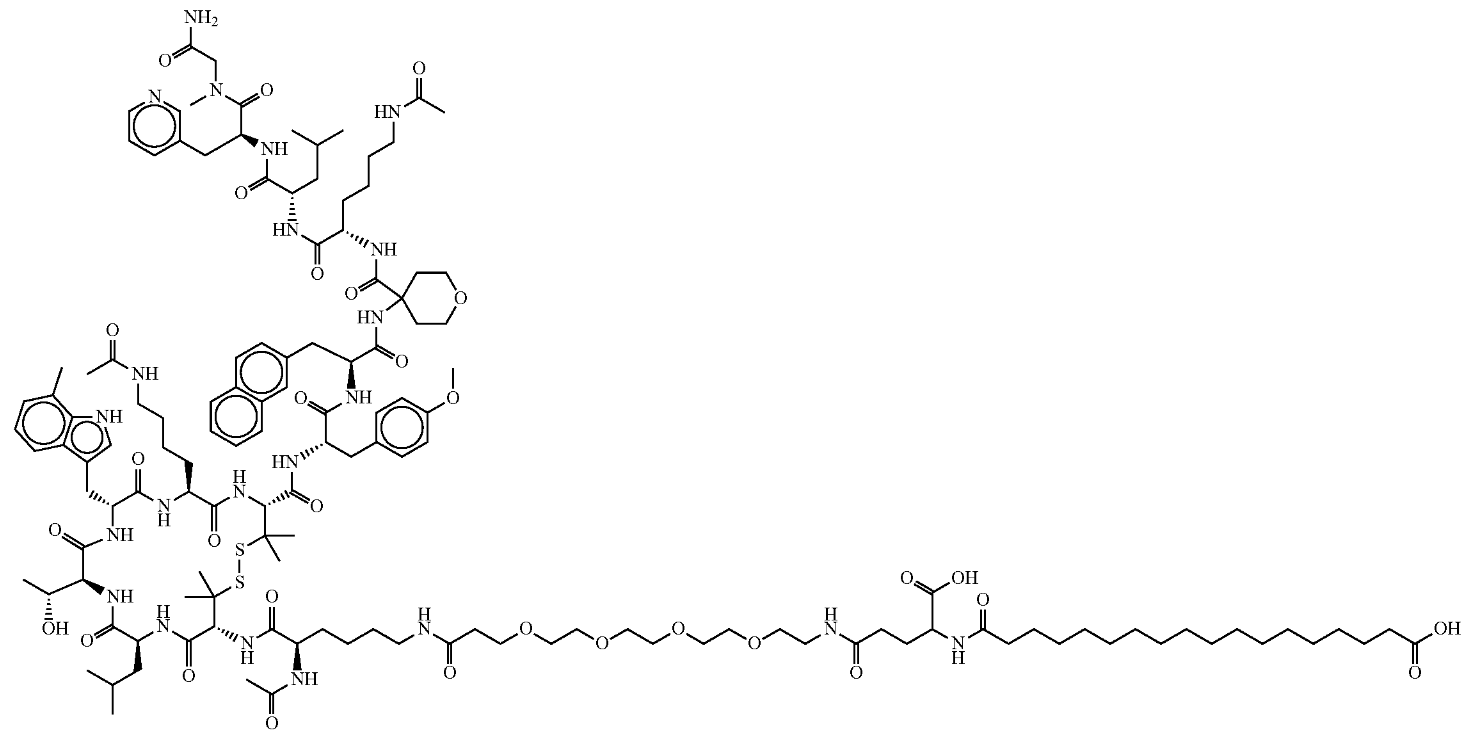 |

TABLE 1I-continued
| Compounds. | |
|---|---|
| SEQ ID. | Structure |
| 201 | Ac-[(D)Lys(PEG12_IsoGlu_Palm)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 259) 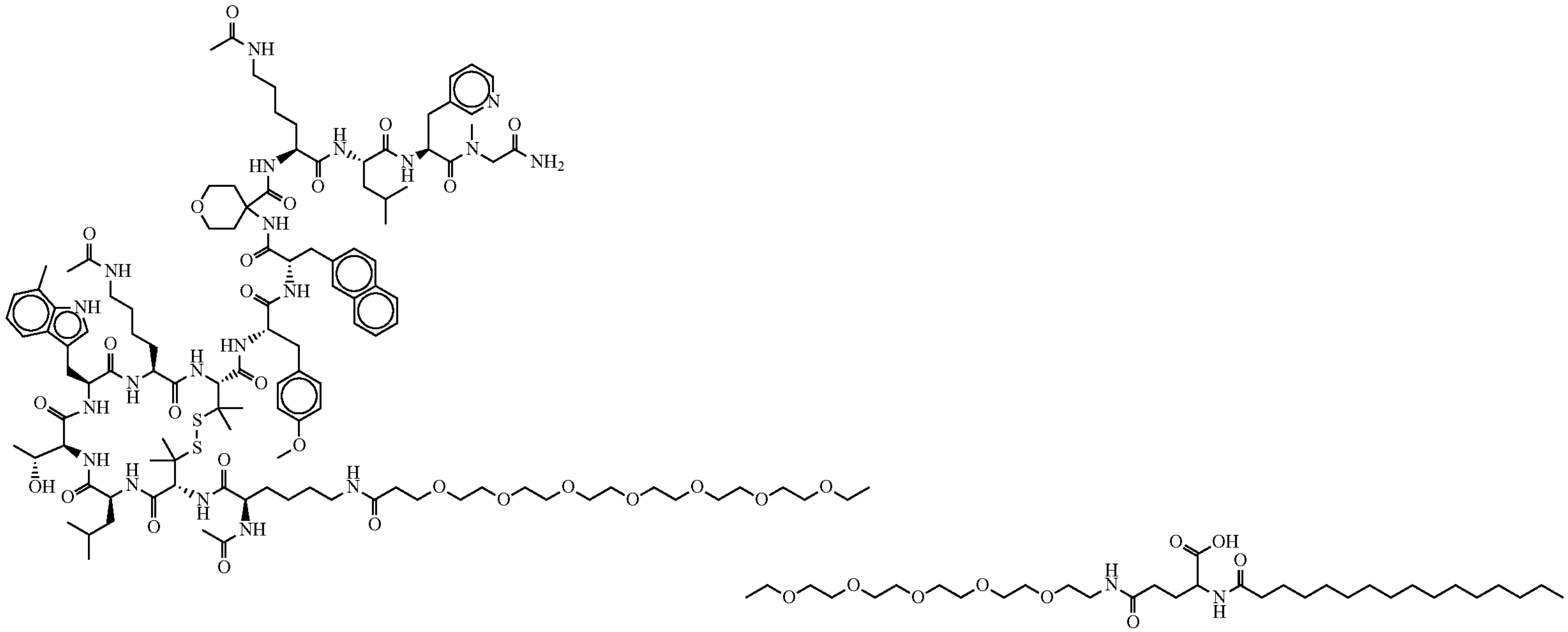 |

TABLE 1I-continued
| Compounds. | |
|---|---|
| SEQ ID. | Structure |
| 202 | Ac-[(D)Lys(PEG12_IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 260) 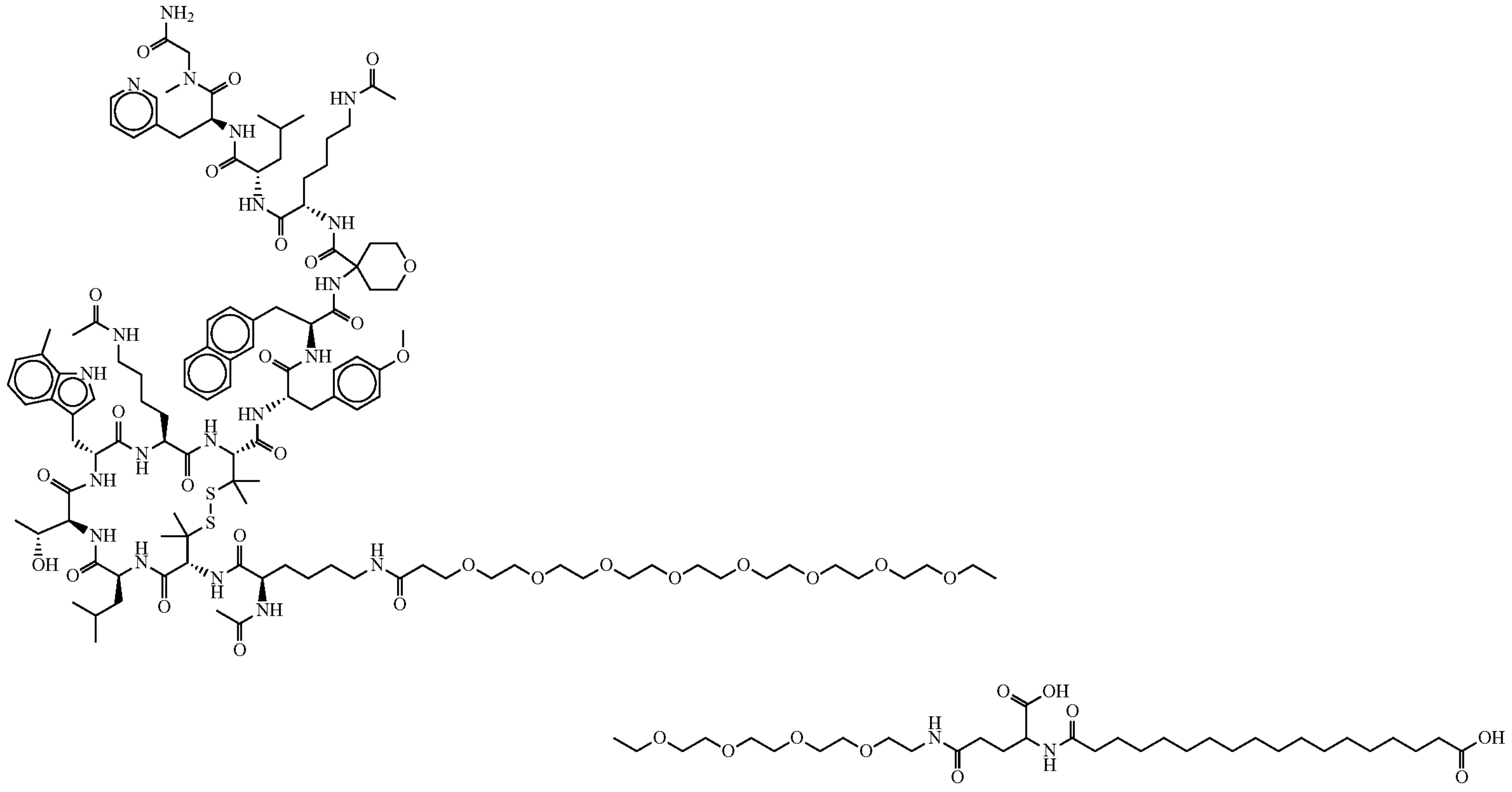 |

TABLE 1I-continued
| Compounds. | |
|---|---|
| SEQ ID. | Structure |
| 203 | Ac-[Pen]-L-T-[Trp(7-Me)]-[Lys(PEG12_C18_Diacid)]-[Pen]-[Phe(4-OMe)]-[2Nal]-[THP]-L-L-[3Pal]-[Sarc]-NH2 (Example 261)<br>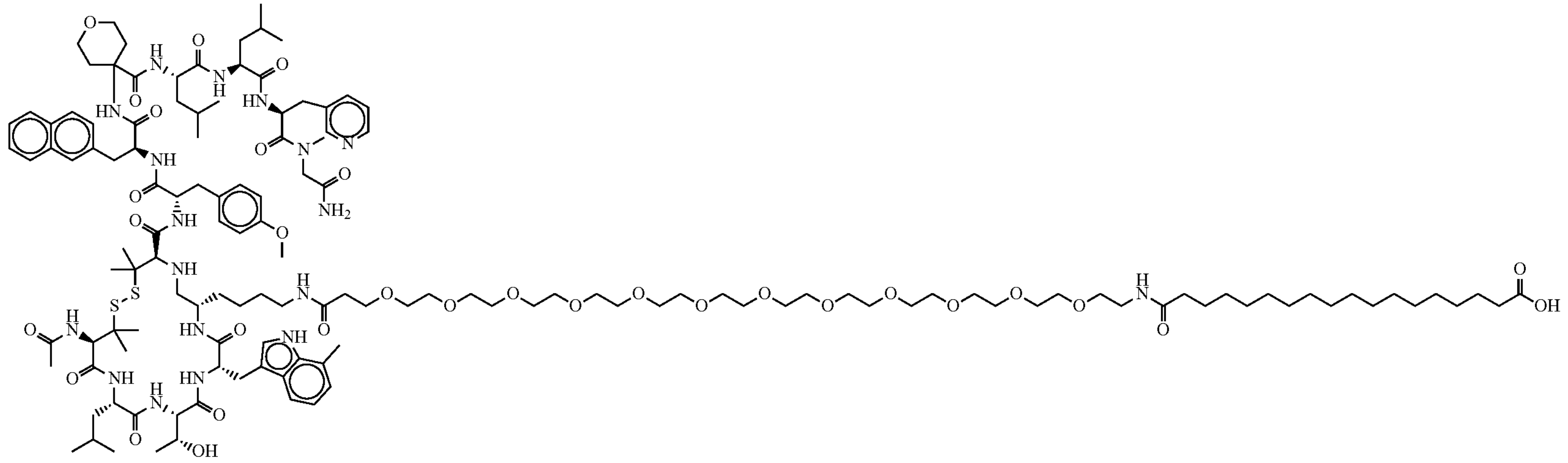 |

TABLE 1I-continued
| Compounds. | |
|---|---|
| SEQ ID. | Structure |
| 204 | Ac-[Pen]-L-T-[Trp(7-Me)]-[Lys(PEG4_C18_Diacid)]-[Pen]-[Phe(4-OMe)]-[2Nal]-[THP]-L-L-[3Pal]-[Sarc]-NH2 (Example 262) 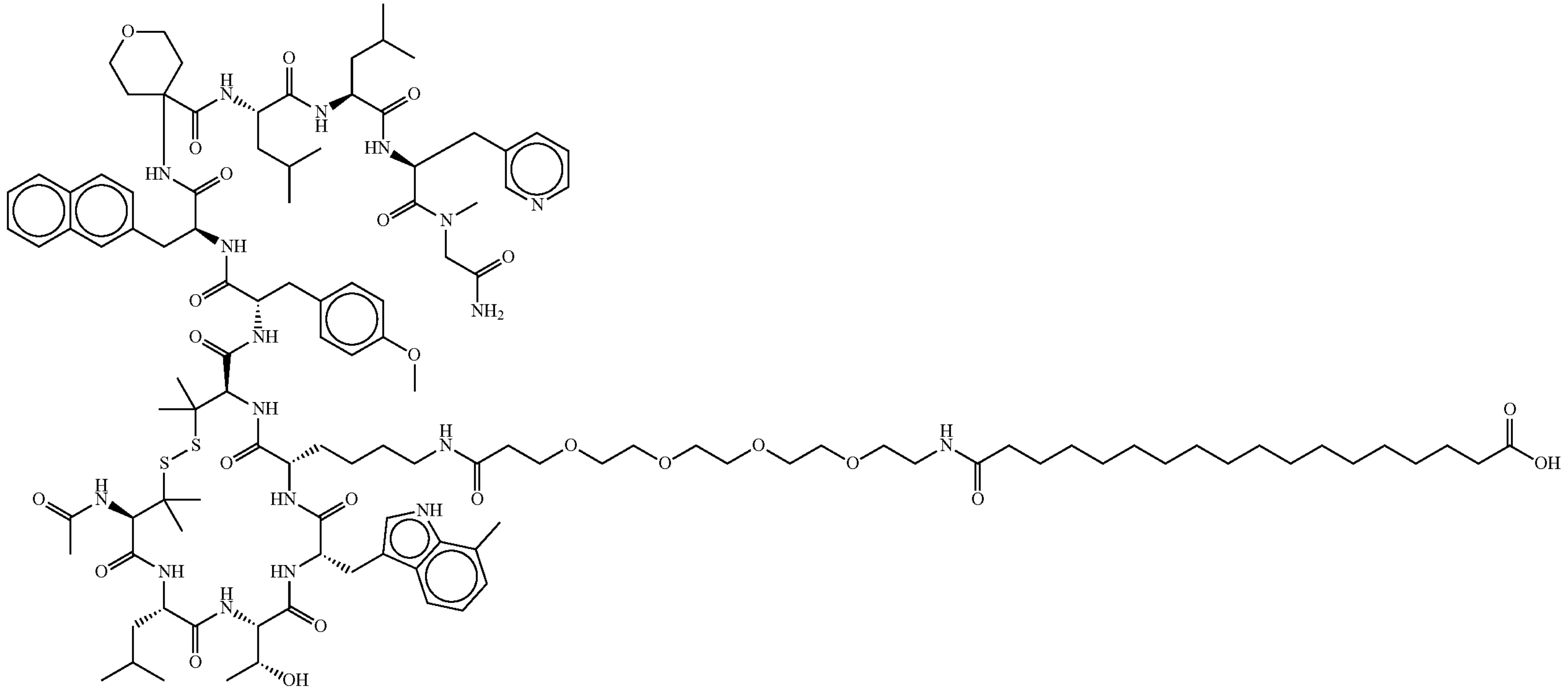 |

TABLE 1I-continued
| Compounds. | |
|---|---|
| SEQ ID. | Structure |
| 205 | Ac-[Pen]-L-T-[Trp(7-Me)]-[Lys(IsoGlu_C18_Diacid)]-[Pen]-[Phe(4-OMe)]-[2Nal]-[THP]-L-L-[3Pal]-[Sarc]-NH2 (Example 263)<br>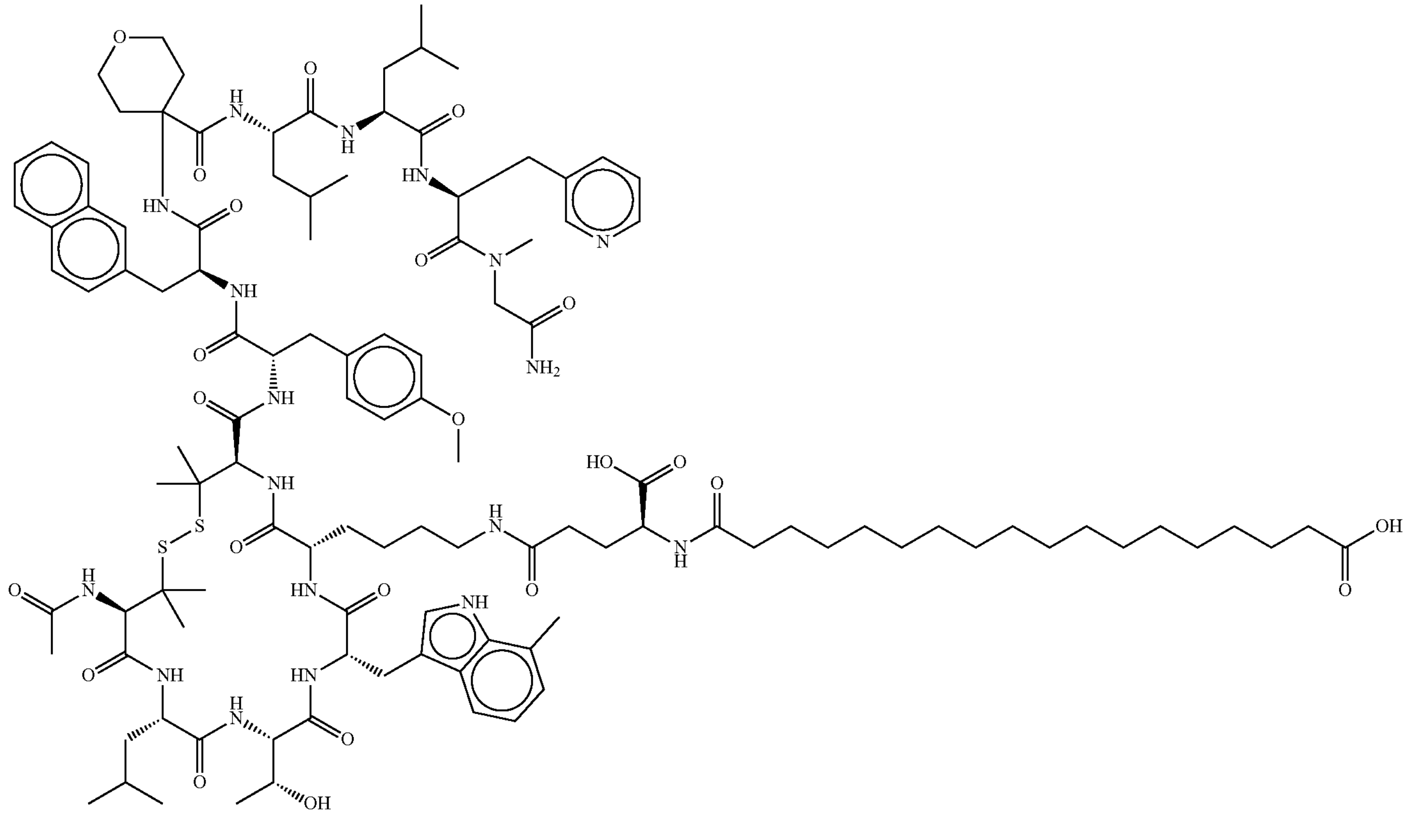 |

TABLE 1I-continued
| Compounds. | |
|---|---|
| SEQ ID. | Structure |
| 206 | Ac-[Pen]-L-T-[Trp(7-Me)]-[Lys(IsoGlu_Palm)]-[Pen]-[Phe(4-OMe)]-[2Nal]-[THP]-L-L-[3Pal]-[Sarc]-NH2 (Example 264) 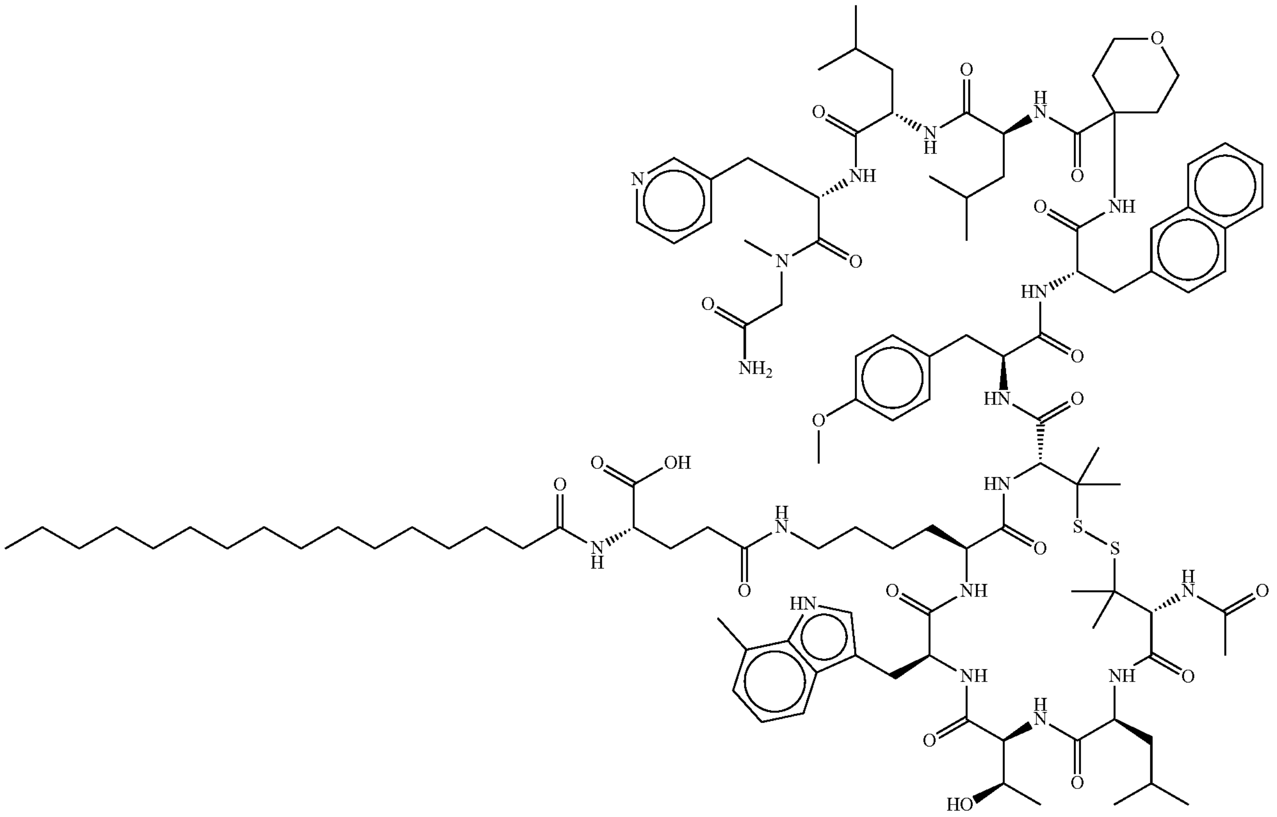 |

TABLE 1I-continued
| Compounds. | |
|---|---|
| SEQ ID. | Structure |
| 207 | Ac-[Pen]-L-T-[Trp(7-Me)]-[Lys(PEG4_IsoGlu_Palm)]-[Pen]-[Phe(4-OMe)]-[2Nal]-[THP]-L-L-[3Pal]-[Sarc]-NH2 (Example 265) 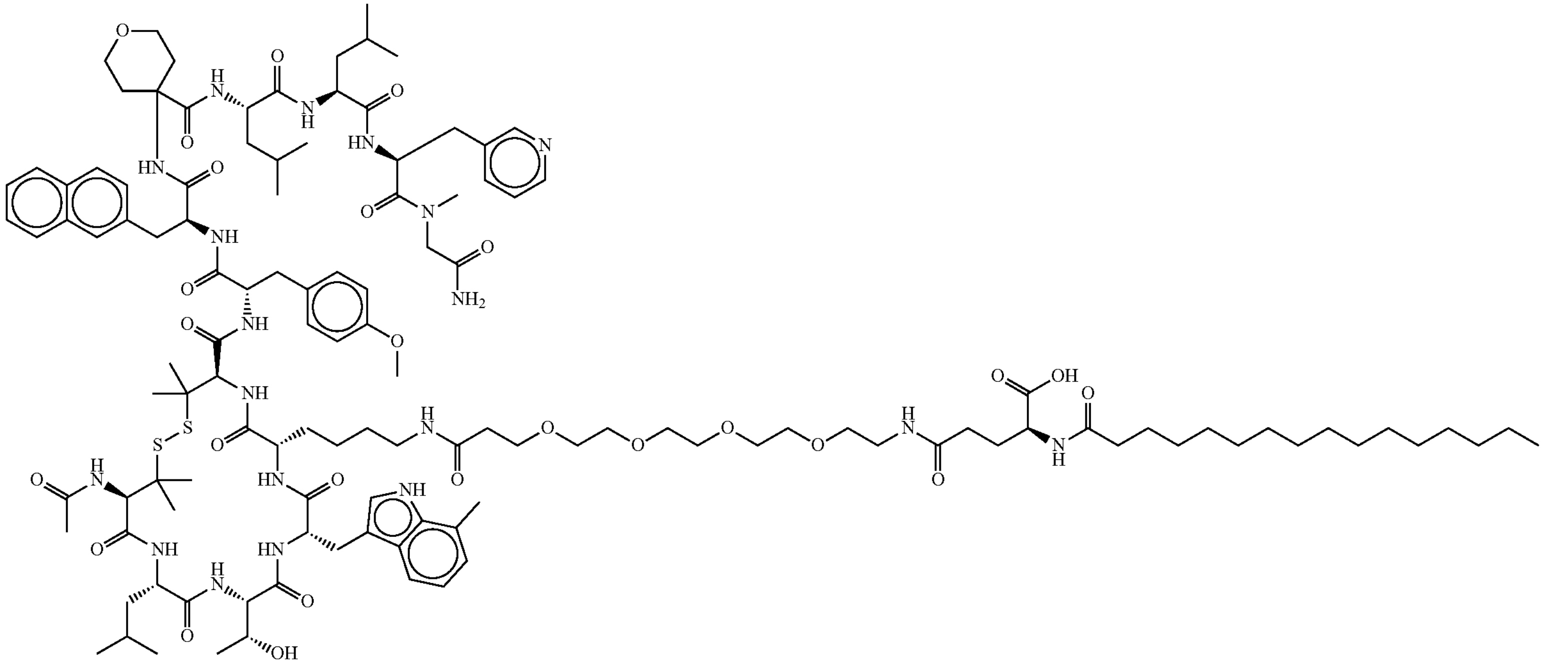 |

TABLE 1I-continued
| Compounds. | |
|---|---|
| SEQ ID. | Structure |
| 208 | Ac-[Pen]-L-T-[Trp(7-Me)]-[Lys(PEG4_IsoGlu_C18_Diacid)]-[Pen]-[Phe(4-OMe)]-[2Nal]-[THP]-L-L-[3Pal]-[Sarc]-NH2 (Example 266) 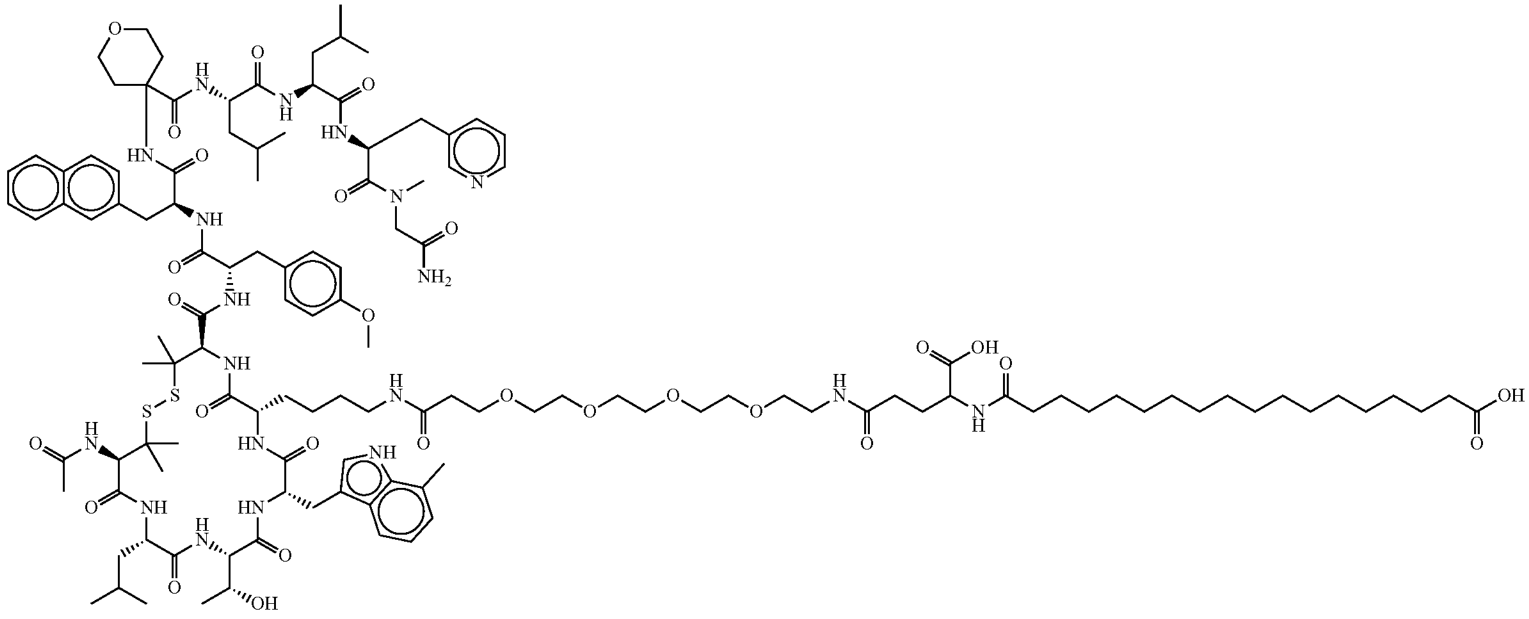 |

TABLE 1I-continued
| Compounds. | |
|---|---|
| SEQ ID. | Structure |
| 209 | Ac-[Pen]-L-T-[Trp(7-Me)]-[Lys(PEG12_IsoGlu_Palm)]-[Pen]-[Phe(4-OMe)]-[2Nal]-[THP]-L-L-[3Pal]-[Sarc]-NH2 (Example 267) 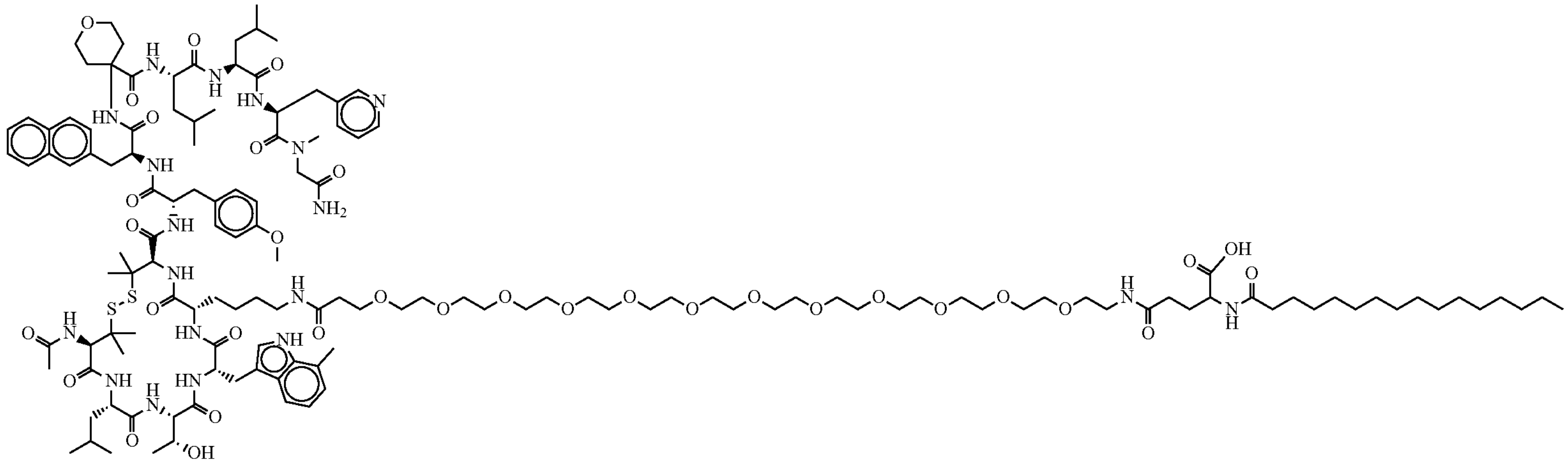 |

TABLE 1I-continued
| Compounds. | |
|---|---|
| SEQ ID. | Structure |
| 210 | Ac-[Pen]-L-T-[Trp(7-Me)]-[Lys(PEG12_IsoGlu_C18_Diacid)]-[Pen]-[Phe(4-OMe)]-[2Nal]-[THP]-L-L-[3Pal]-[Sarc]-NH2 (Example 268)<br>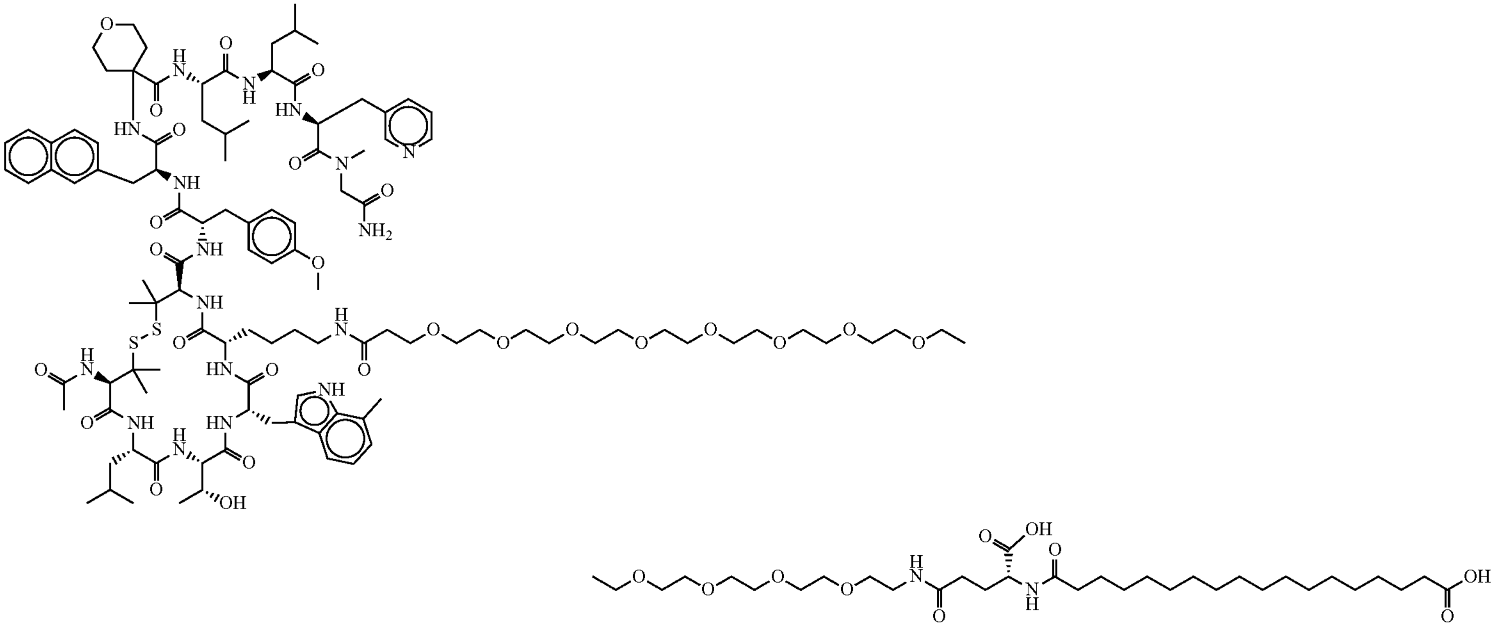 |

TABLE 1I-continued
| Compounds. | |
|---|---|
| SEQ ID. | Structure |
| 211 | Ac-[Pen]-L-T-[Trp(7-Me)]-[Lys(PEG12_C18_Diacid)]-[Pen]-[Phe(4-OMe)]-[2Nal]-[THP]-[Lys(Ac)]-L-[3Pal]-[Sarc]-NH2 (Example 269) 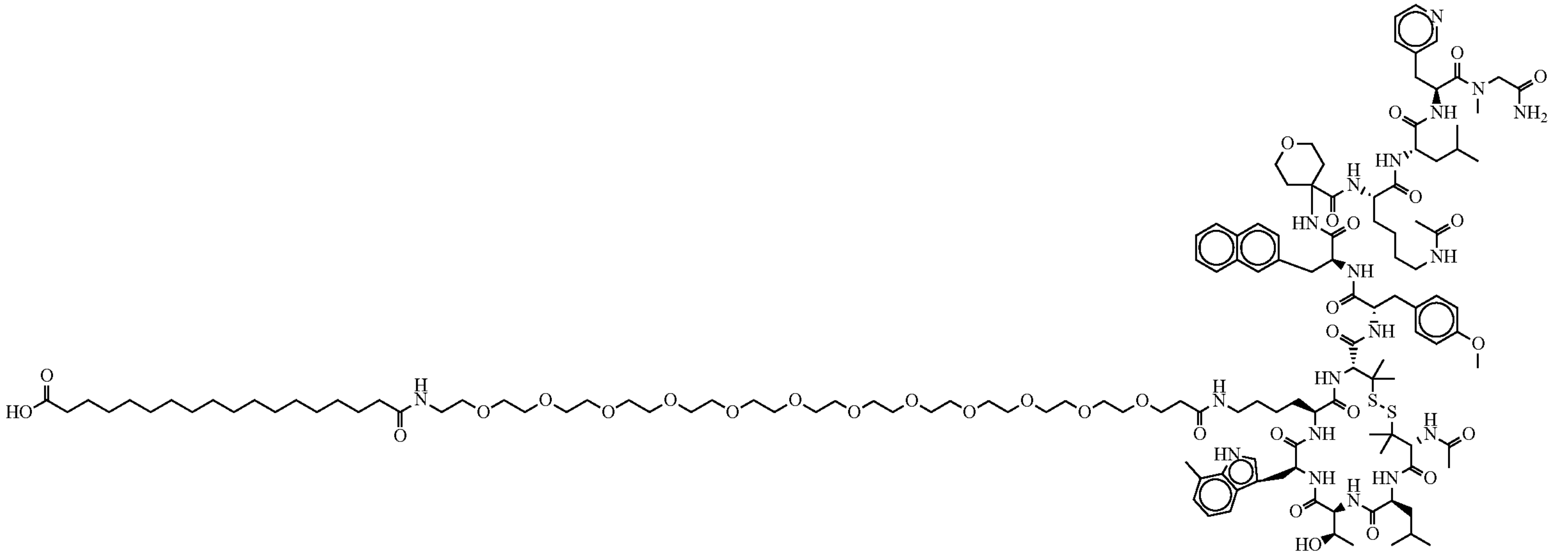 |

TABLE 1I-continued
| Compounds. | |
|---|---|
| SEQ ID. | Structure |
| 212 | Ac-[Pen]-L-T-[Trp(7-Me)]-[Lys(PEG4_C18_Diacid)]-[Pen]-[Phe(4-OMe)]-[2Nal]-[THP]-[Lys(Ac)]-L-[3Pal]-[Sarc]-NH2 (Example 270)<br>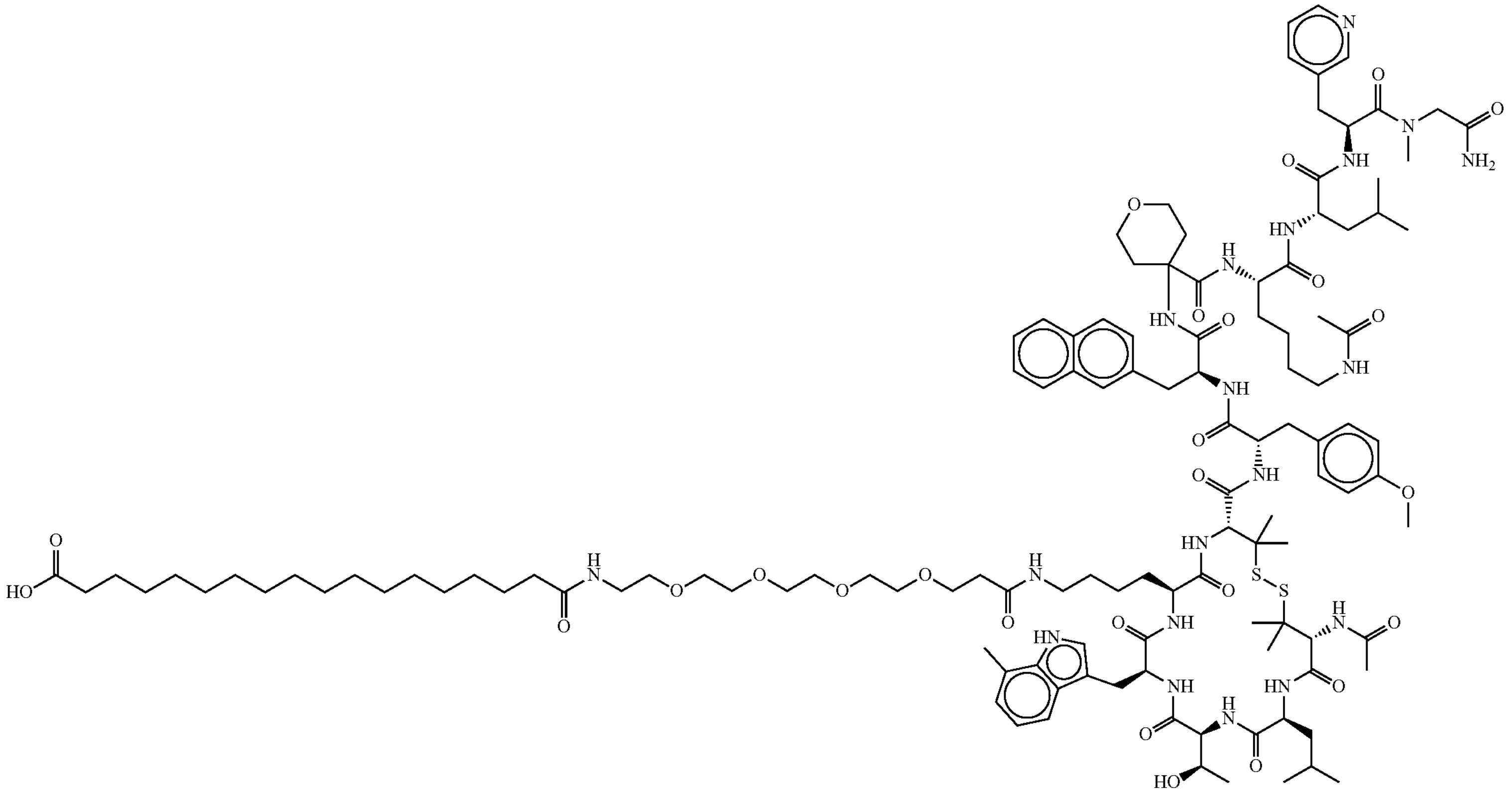 |

TABLE 1I-continued
| Compounds. | |
|---|---|
| SEQ ID. | Structure |
| 213 | Ac-[Pen]-L-T-[Trp(7-Me)]-[Lys(IsoGlu_C18_Diacid)]-[Pen]-[Phe(4-OMe)]-[2Nal]-[THP]-[Lys(Ac)]-L-[3Pal]-[Sarc]-NH2 (Example 271) 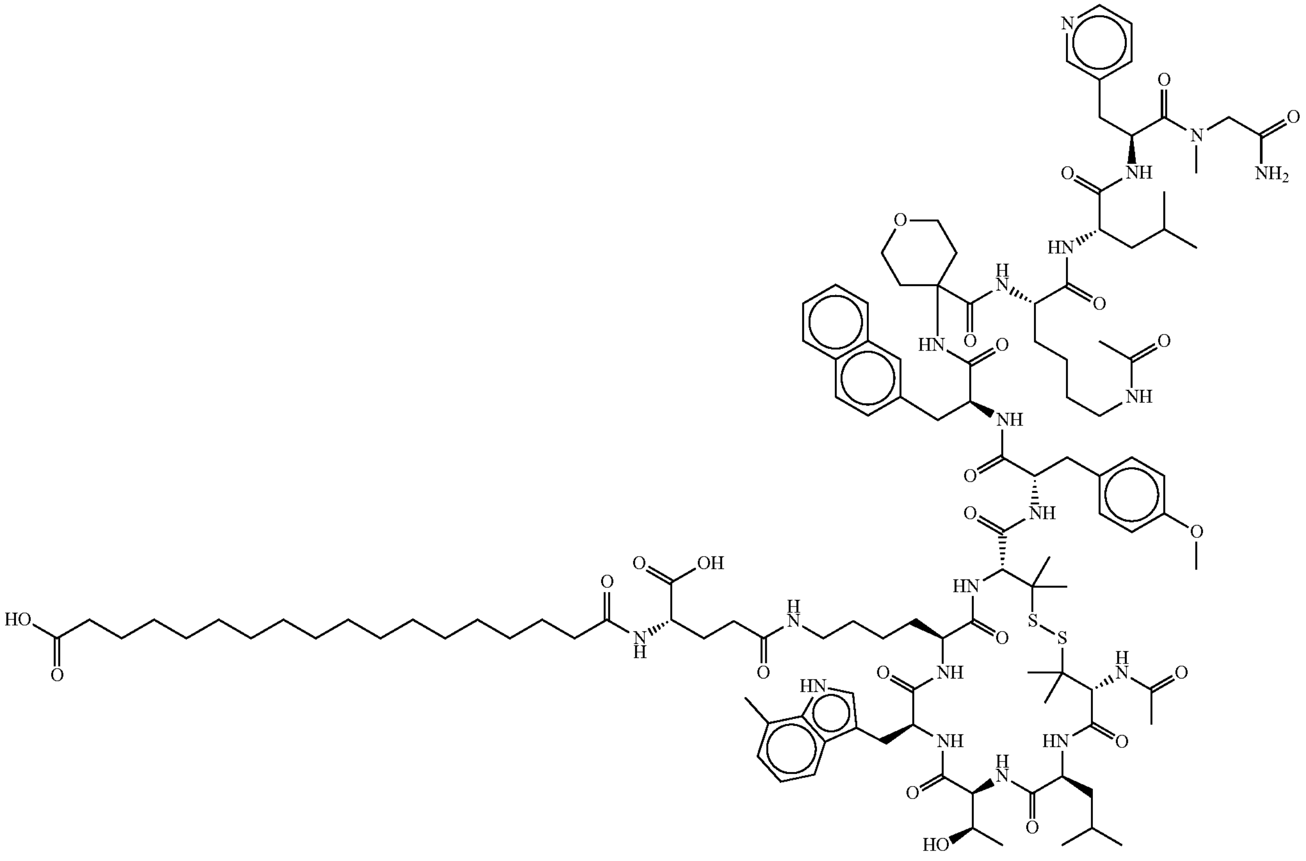 |

TABLE 1I-continued
| Compounds. | |
|---|---|
| SEQ ID. | Structure |
| 214 | Ac-[Pen]-L-T-[Trp(7-Me)]-[Lys(IsoGlu_Palm)]-[Pen]-[Phe(4-OMe)]-[2Nal]-[THP]-[Lys(Ac)]-L-[3Pal]-[Sarc]-NH2 (Example 272)<br>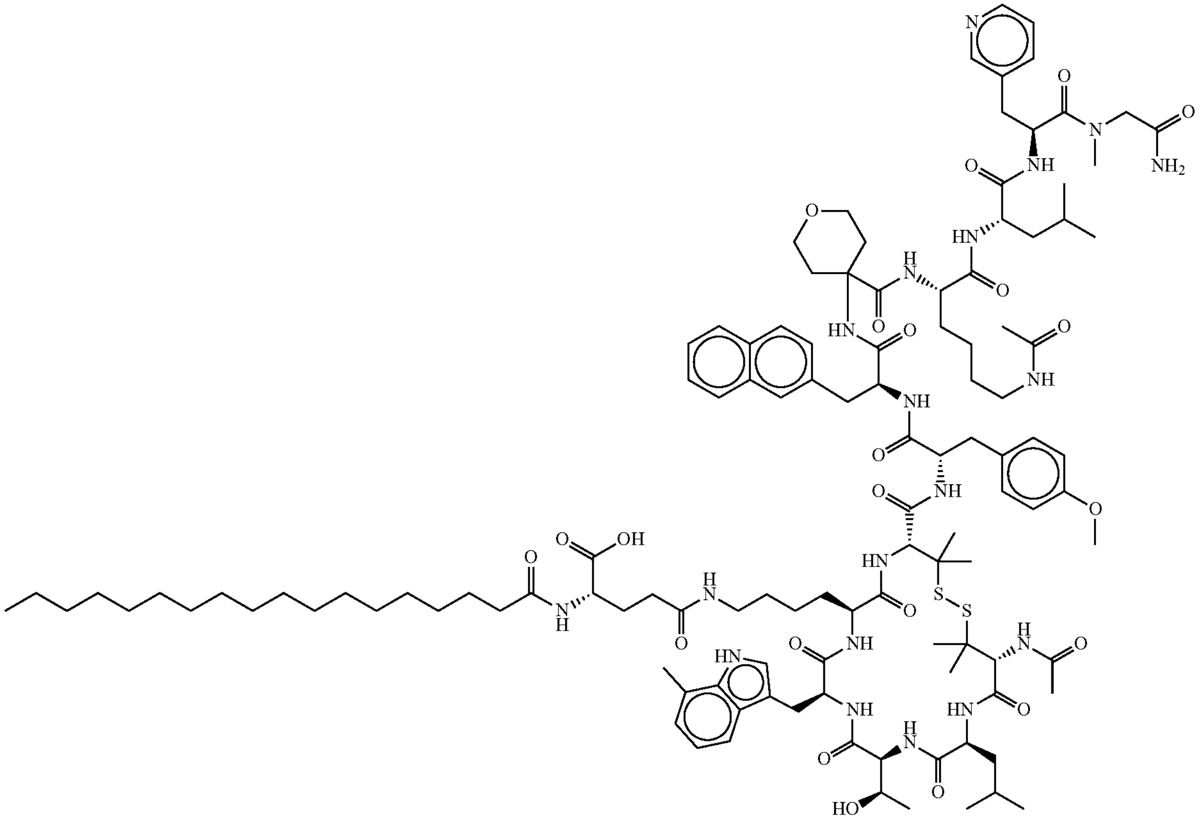 |

TABLE 1I-continued
| Compounds. | |
|---|---|
| SEQ ID. | Structure |
| 215 | Ac-[Pen]-L-T-[Trp(7-Me)]-[Lys(PEG4_IsoGlu_Palm)]-[Pen]-[Phe(4-OMe)]-[2Nal]-[THP]-[Lys(Ac)]-L-[3Pal]-[Sarc]-NH2 (Example 273) 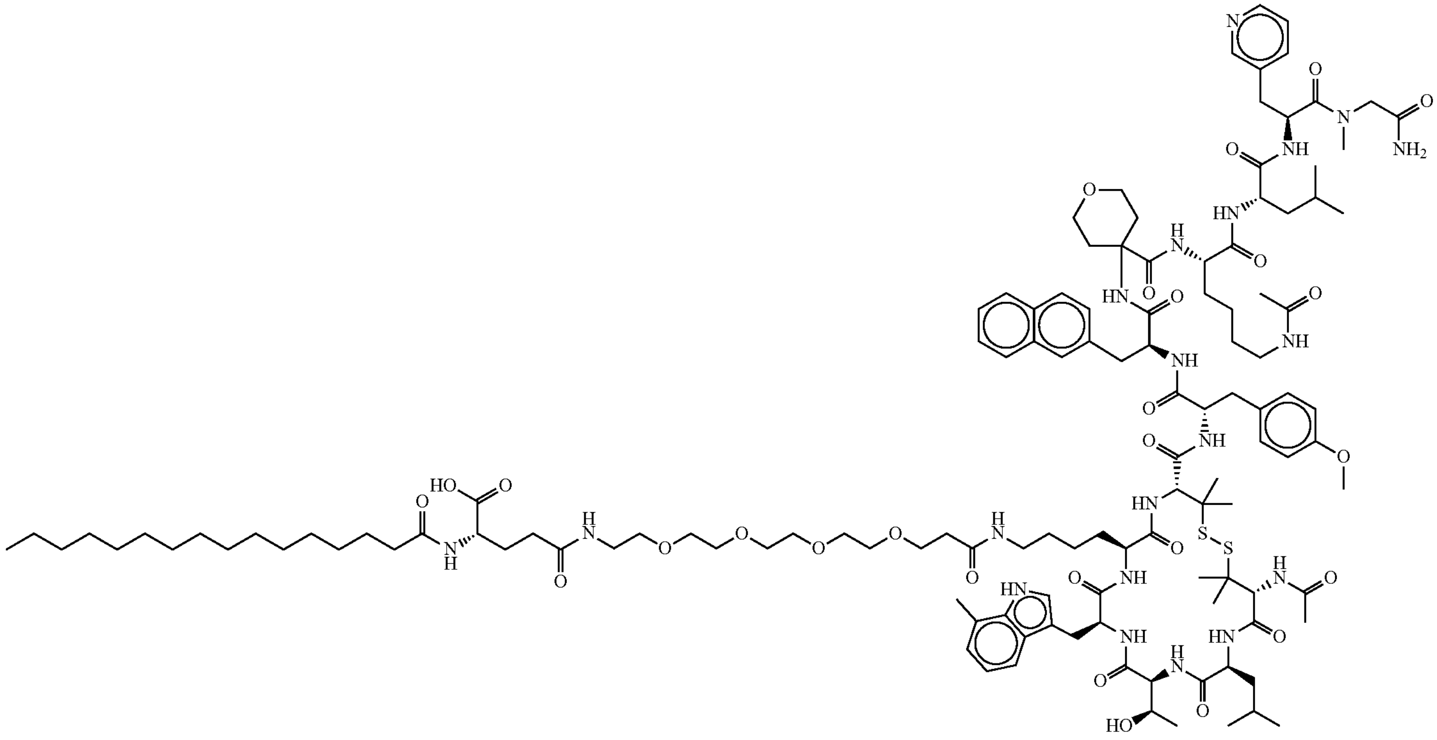 |

TABLE 1I-continued
| Compounds. | |
|---|---|
| SEQ ID. | Structure |
| 216 | Ac-[Pen]-L-T-[Trp(7-Me)]-[Lys(PEG4_IsoGlu_C18_Diacid)]-[Pen]-[Phe(4-OMe)]-[2Nal]-[THP]-[Lys(Ac)]-L-[3Pal]-[Sarc]-NH2 (Example 274)<br>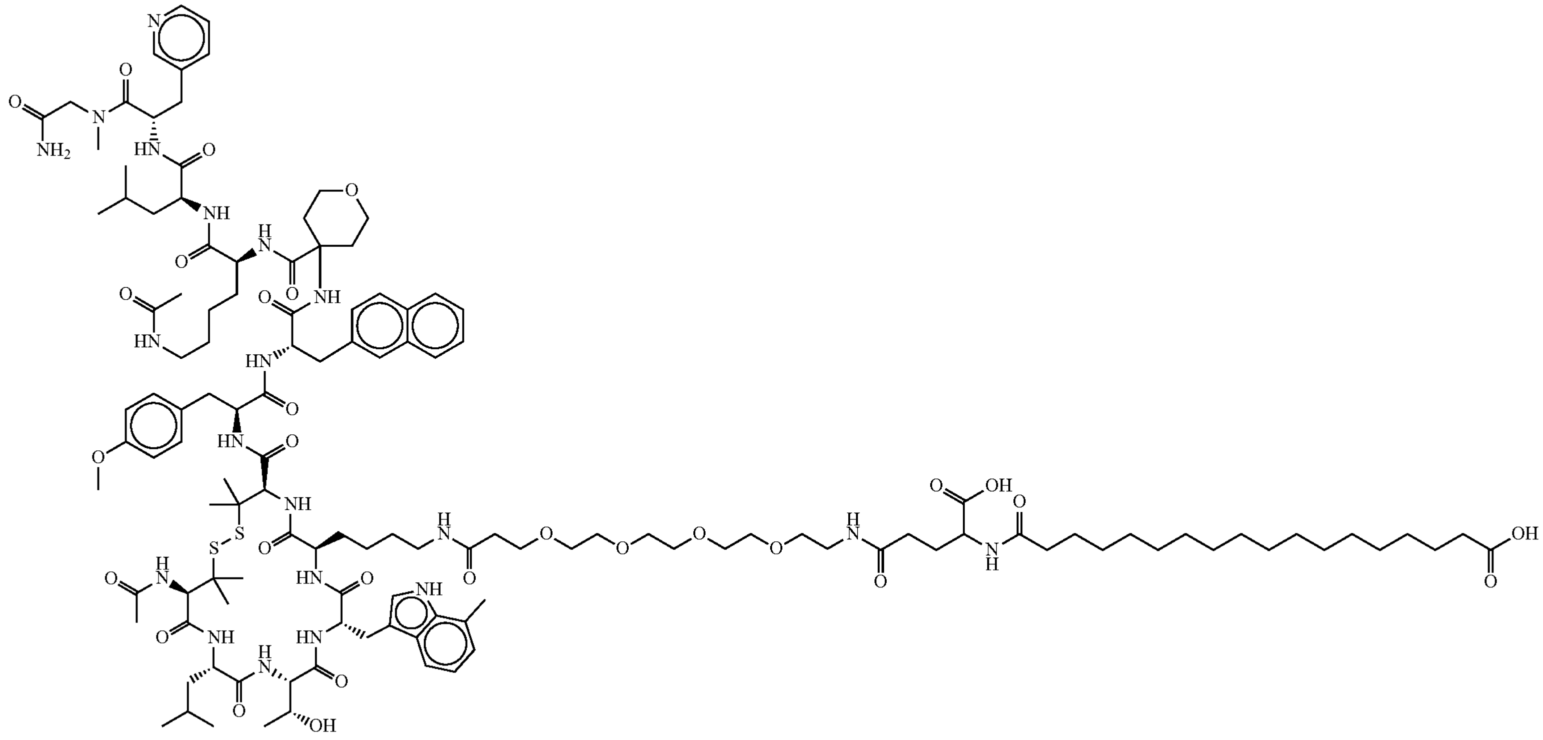 |

TABLE 1I-continued
| Compounds. | |
|---|---|
| SEQ ID. | Structure |
| 217 | Ac-[Pen]-L-T-[Trp(7-Me)]-[Lys(PEG12_IsoGlu_Palm)]-[Pen]-[Phe(4-OMe)]-[2Nal]-[THP]-[Lys(Ac)]-L-[3Pal]-[Sarc]-NH2 (Example 275)<br>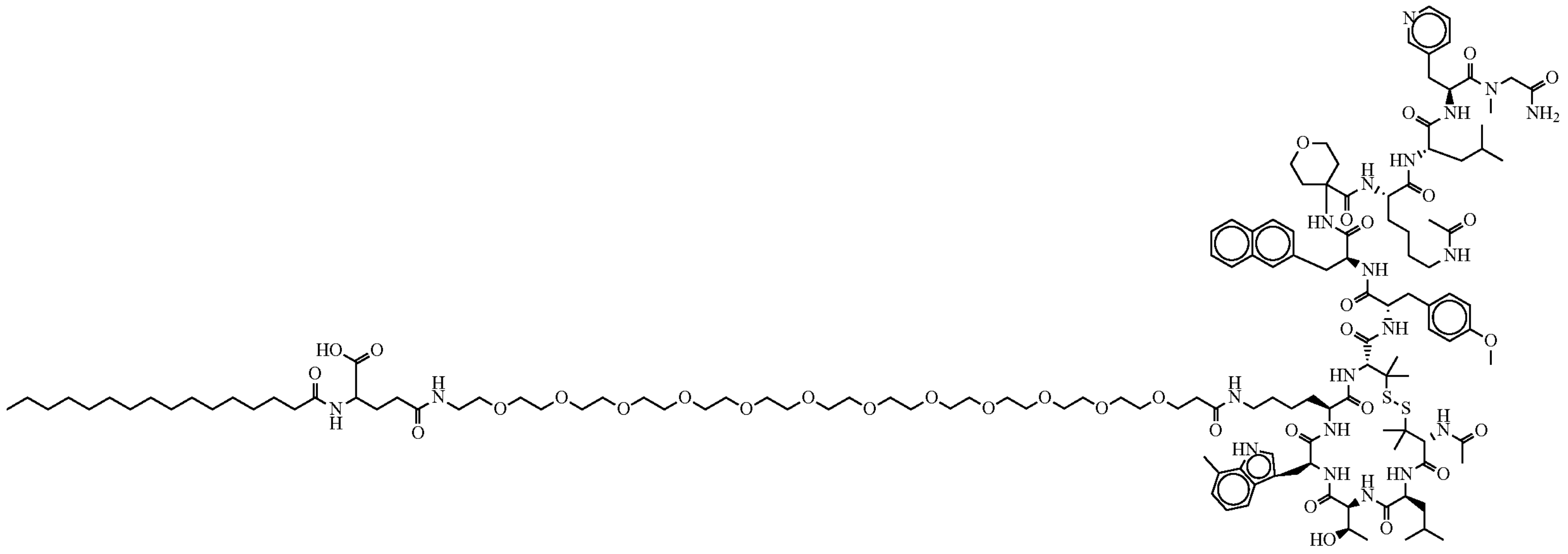 |

TABLE 1J
| Compounds. | |
|---|---|
| SEQ ID. | Structure |
| 218 | Ac-[Pen]-L-T-[Trp(7-Me)]-[Lys(PEG12_IsoGlu_C18_Diacid)]-[Pen]-[Phe(4-OMe)]-[2Nal]-[THP]-[Lys(Ac)]-L-[3Pal]-[Sarc]-NH2 (Example 276) 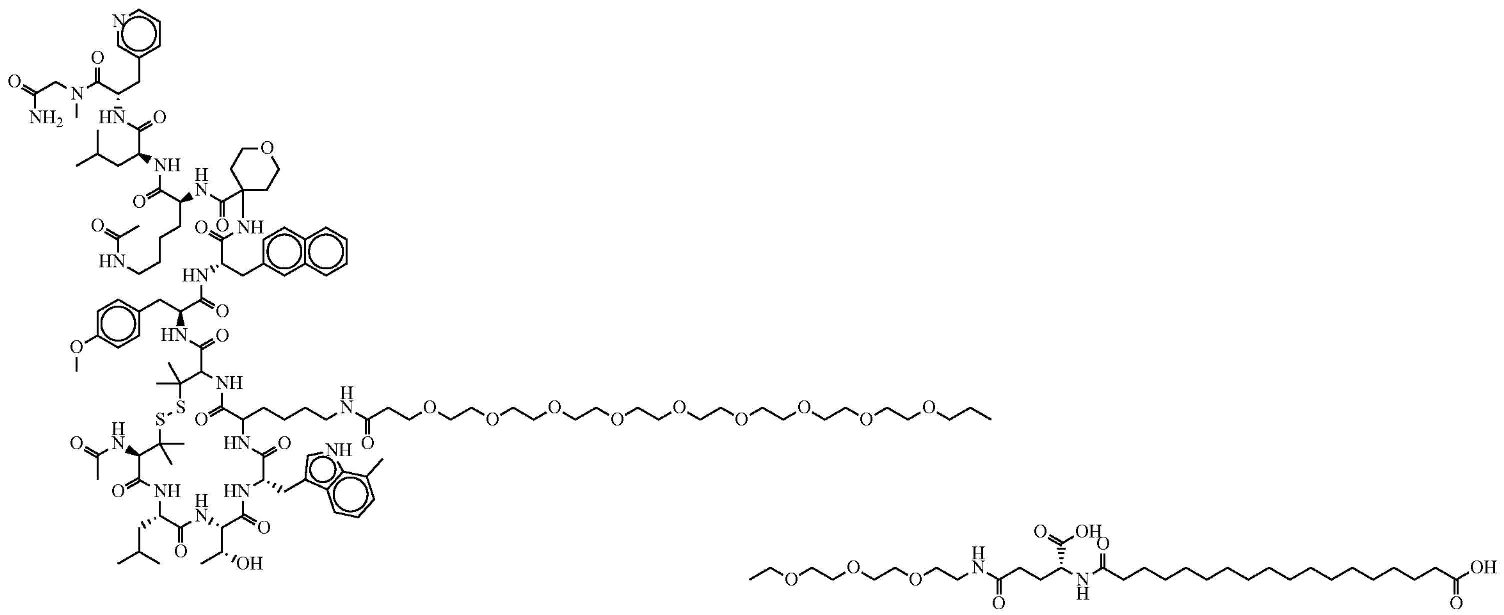 |

TABLE 1J-continued
| Compounds. | |
|---|---|
| SEQ ID. | Structure |
| 219 | Ac-[Pen]-N-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-A-[3Pal]-[Sarc]-NH2 (Example 277) s 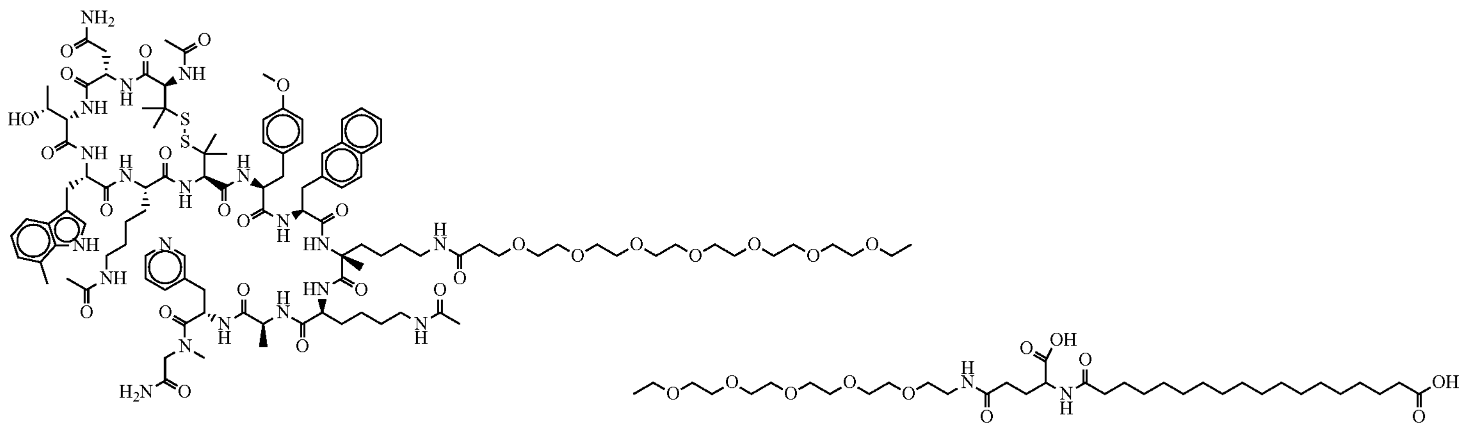 |

TABLE 1J-continued
| Compounds. | |
|---|---|
| SEQ ID. | Structure |
| 220 | Ac-[Pen]-N-T-[Trp(7-Me)]-[Lys(Ac)]-[Pen]-[Phe(4-(2-(PEG4_PEG4_IsoGlu_C18_Diacid)aminoethoxy))]-[2Nal]-[THP]-[Lys(Ac)]-L-[3Pal]-[Sarc]-NH2 (Example 278)<br>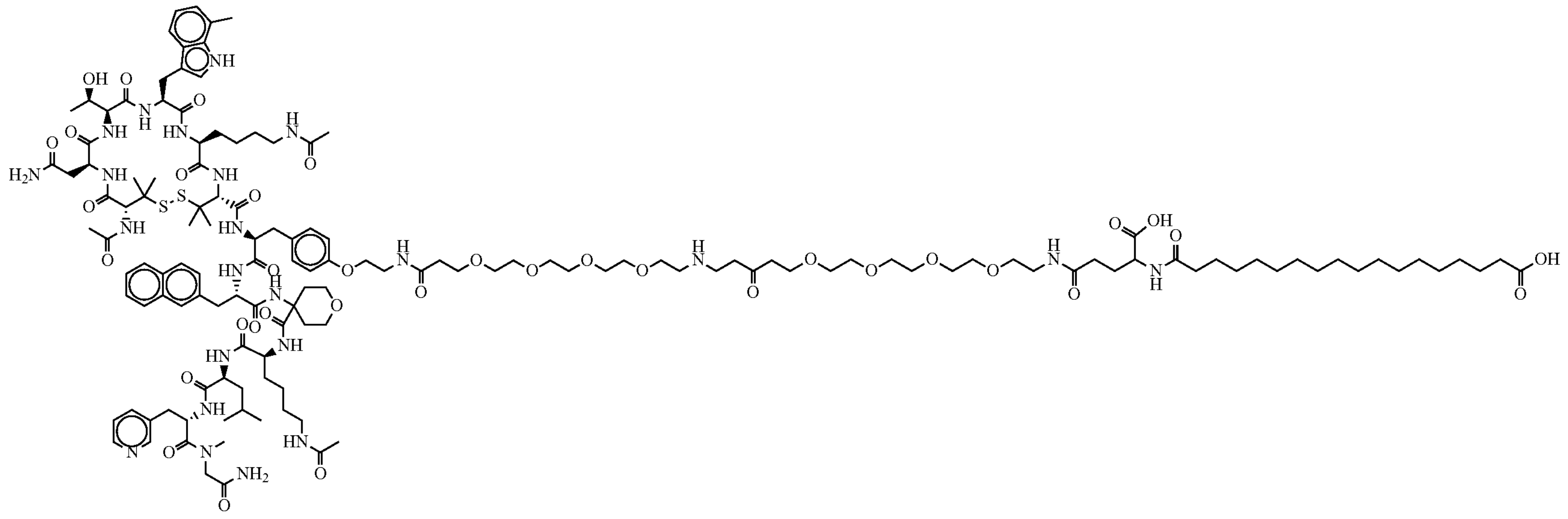 |

TABLE 1J-continued
| Compounds. | |
|---|---|
| SEQ ID. | Structure |
| 221 | Ac-[Pen]-N-T-[Trp(7-Me)]-[Lys(Ac)]-[Pen]-[Phe(4-(2-(PEG12_IsoGlu_C18_Diacid)aminoethoxy))]-[2Nal]-[THP]-[Lys(Ac)]-L-[3Pal]-[Sarc]-NH2 (Example 279) 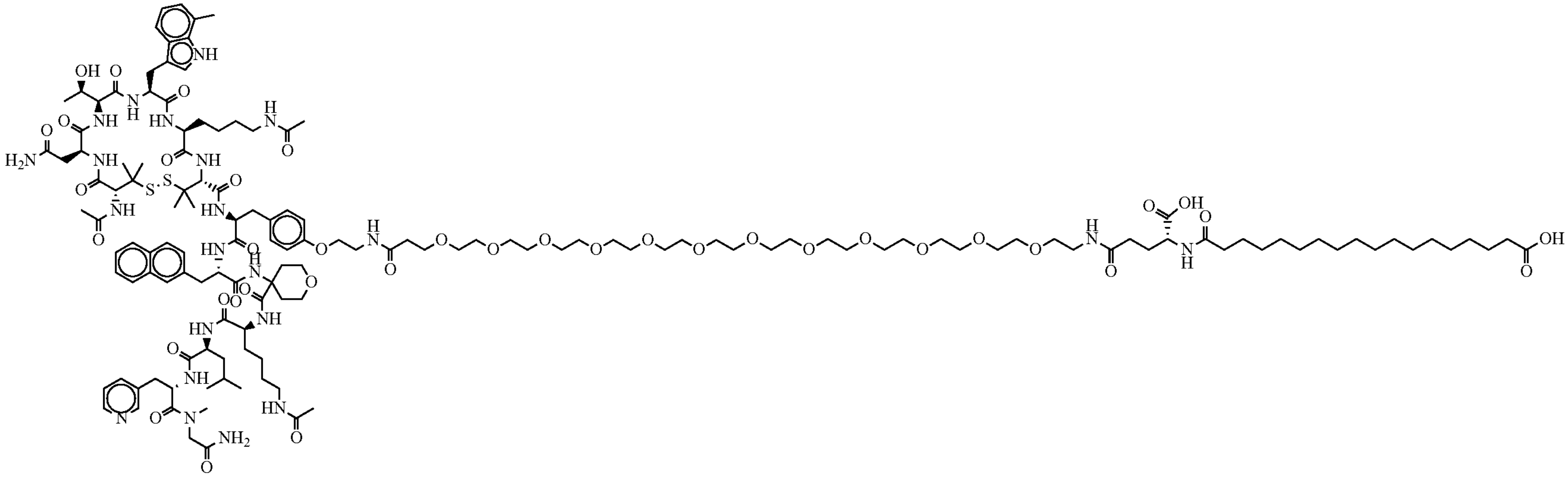 |

TABLE 1J-continued
| Compounds. | |
|---|---|
| SEQ ID. | Structure |
| 222 | Ac-[Pen]-N-T-[Trp(7-Me)]-[Lys(Ac)]-[Pen]-[Phe(4-OMe)]-[2Nal]-[Lys(PEG12_IsoGlu_C18_Diacid)]-[Lys(Ac)]-N-[3Pal]-[Sarc]-NH2 (Example 280) 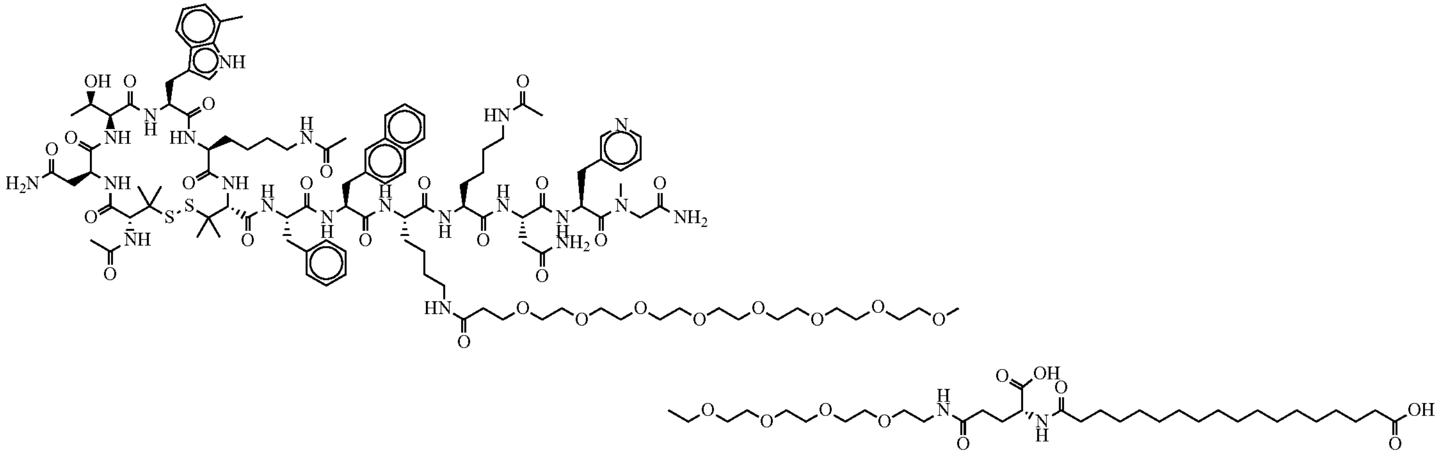 |

TABLE 1J-continued
| Compounds. | |
|---|---|
| SEQ ID. | Structure |
| 223 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12_IsoGlu_C18_Diacid)]-[3Pal]-[Sarc]-NH2 (Example 281) 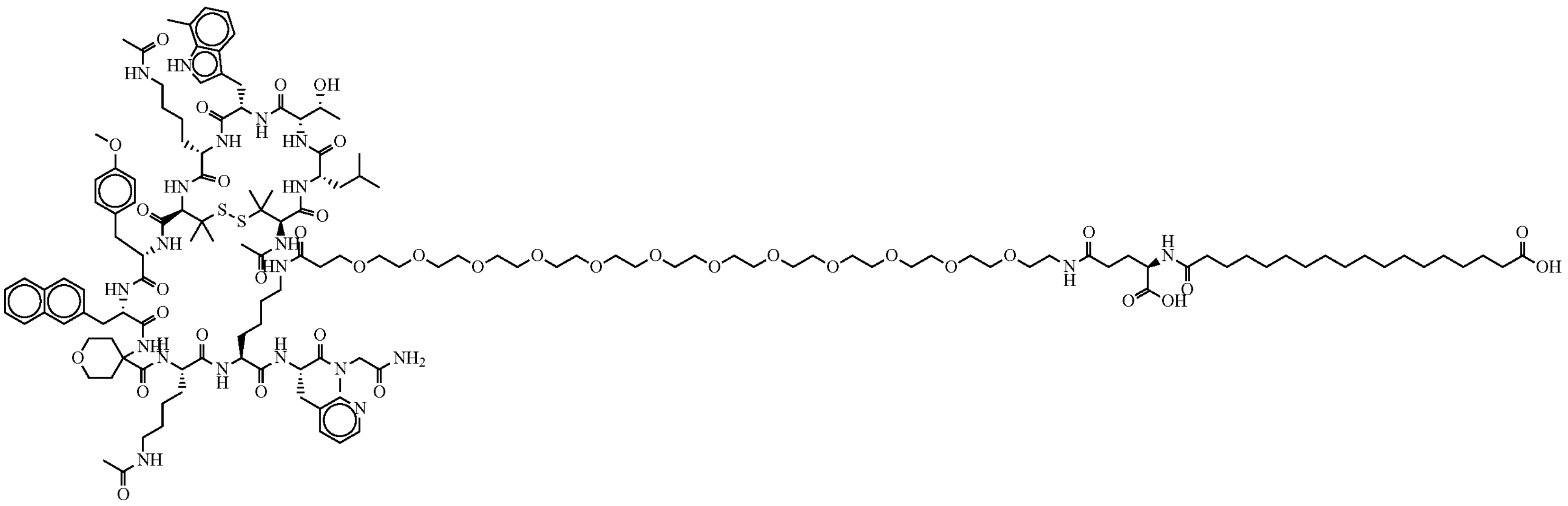 |

TABLE 1J-continued
| Compounds. | |
|---|---|
| SEQ ID. | Structure |
| 224 | Ac-[Pen]-[Lys(PEG12_C18_Diacid)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 (Example 282)) 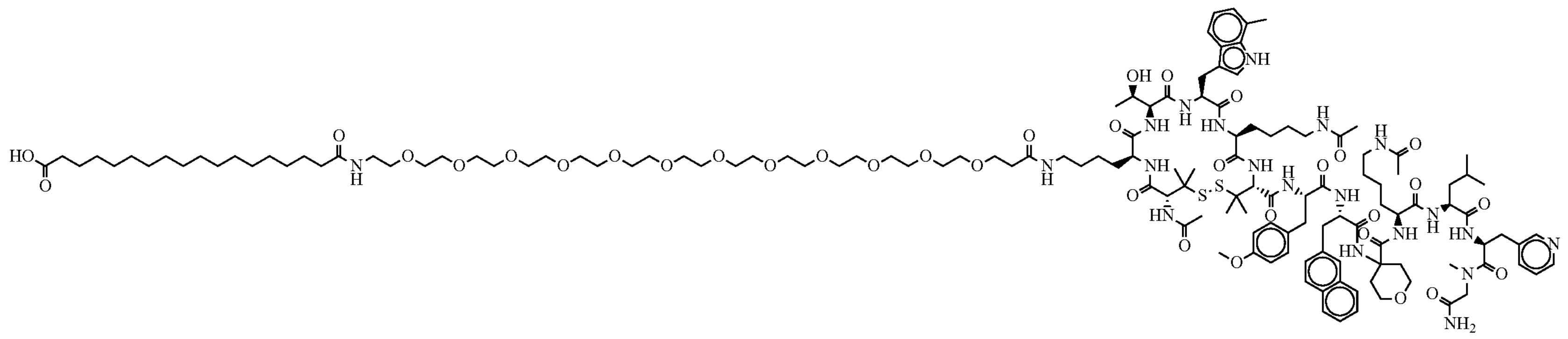 |

TABLE 1J-continued

| Compounds. | |
|---|---|
| SEQ ID. | Structure |
| 225 | [PEG4_Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 283) |

TABLE 1J-continued
| Compounds. | |
| --- | --- |
| SEQ ID. | Structure |
| | 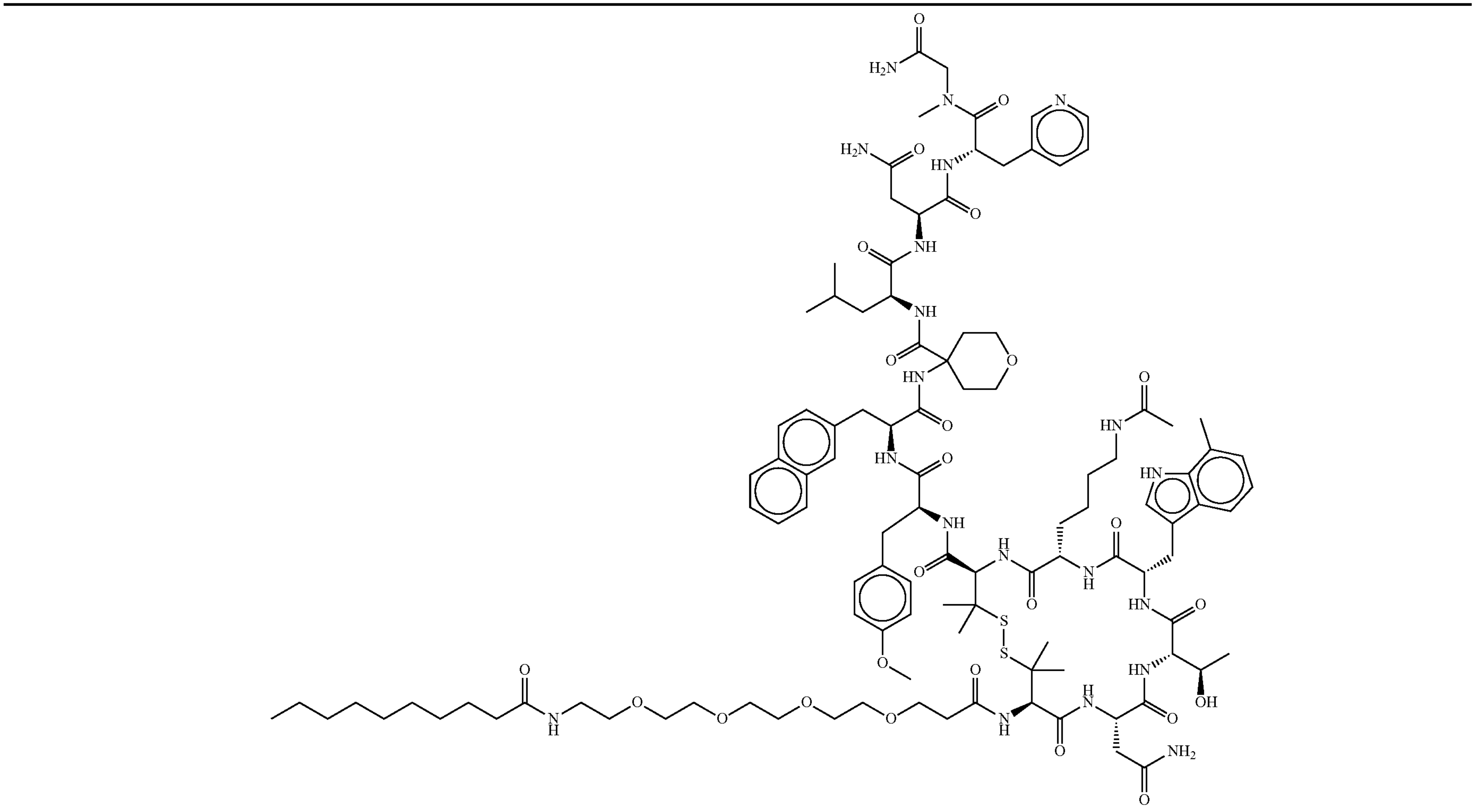 |

TABLE 1J-continued
| Compounds. | |
|---|---|
| SEQ ID. | Structure |
| 226 | [PEG4_Lauryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 284)<br>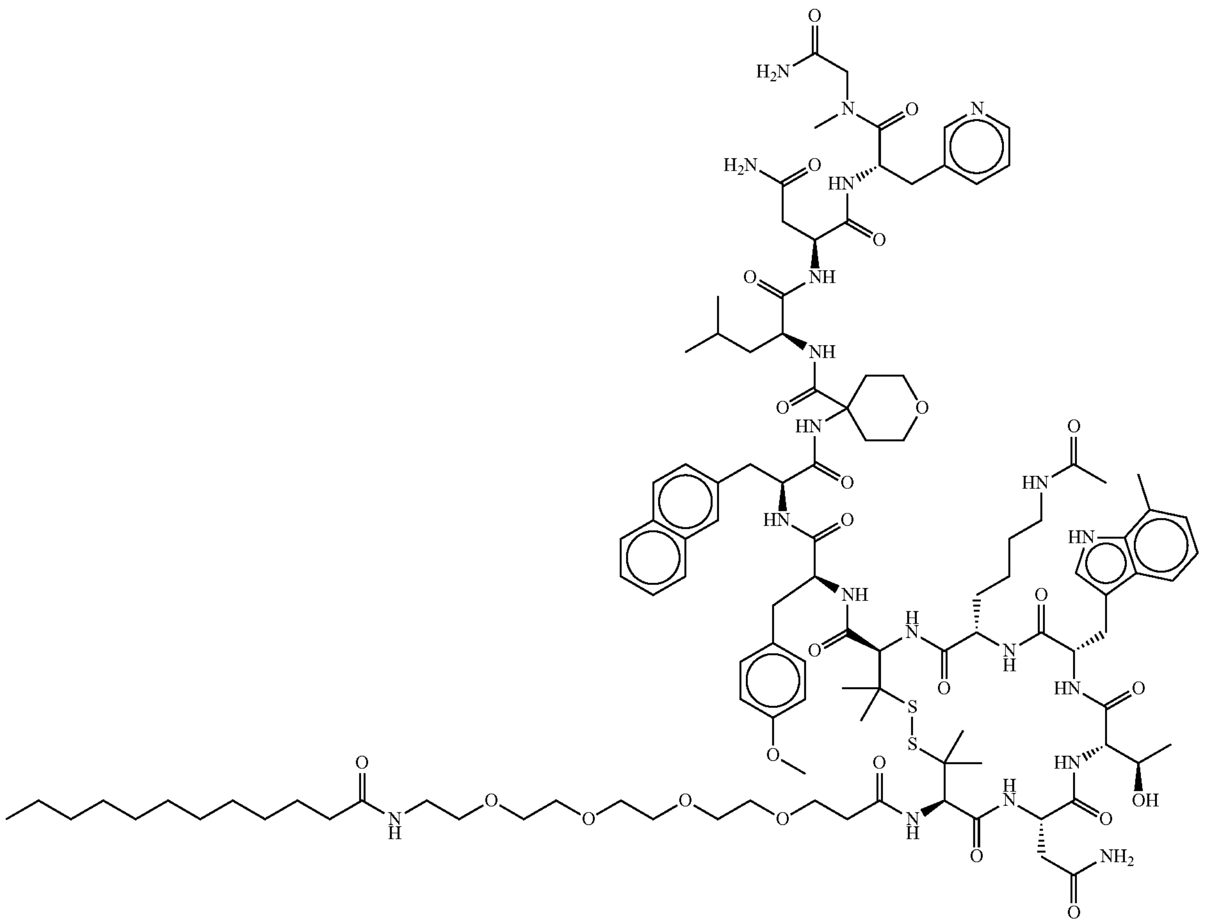 |

TABLE 1J-continued
| Compounds. | |
|---|---|
| SEQ ID. | Structure |
| 227 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12_IsoGlu_C18_Diacid)]-NH2 (Example 285) 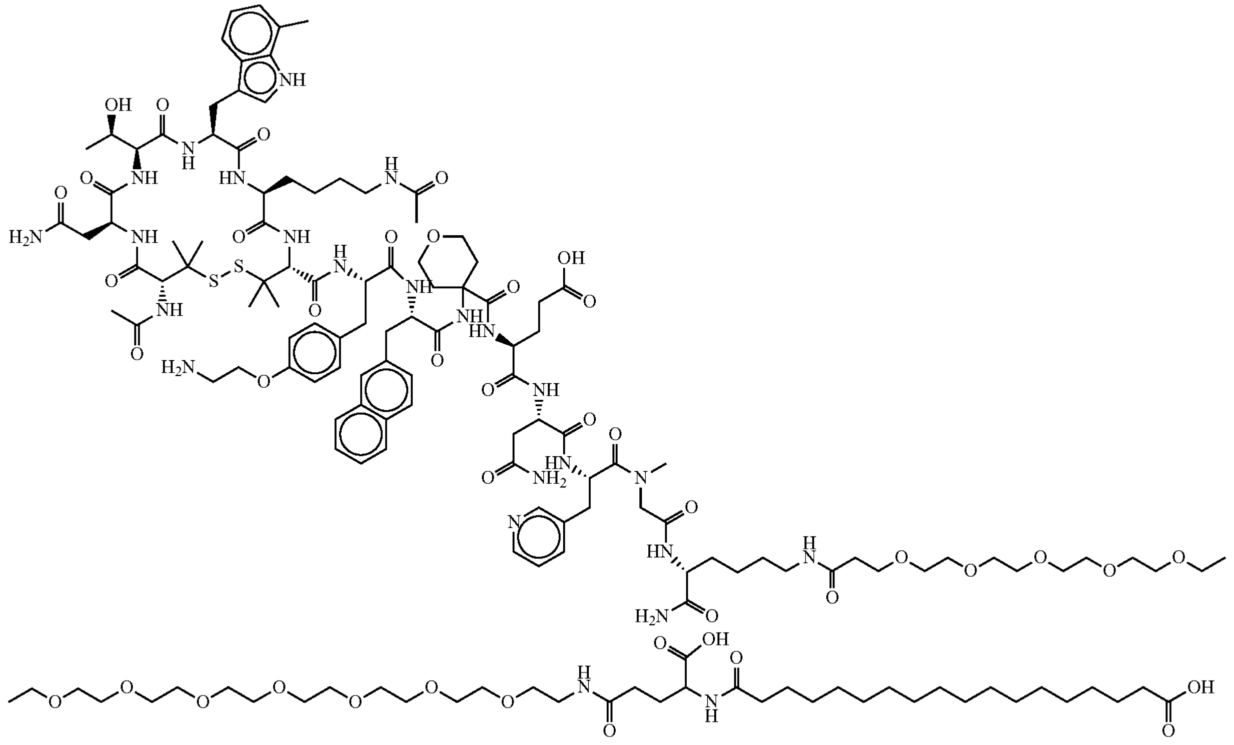 |

TABLE 1J-continued
| Compounds. | |
|---|---|
| SEQ ID. | Structure |
| 228 | [PEG4_Capryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 286)<br>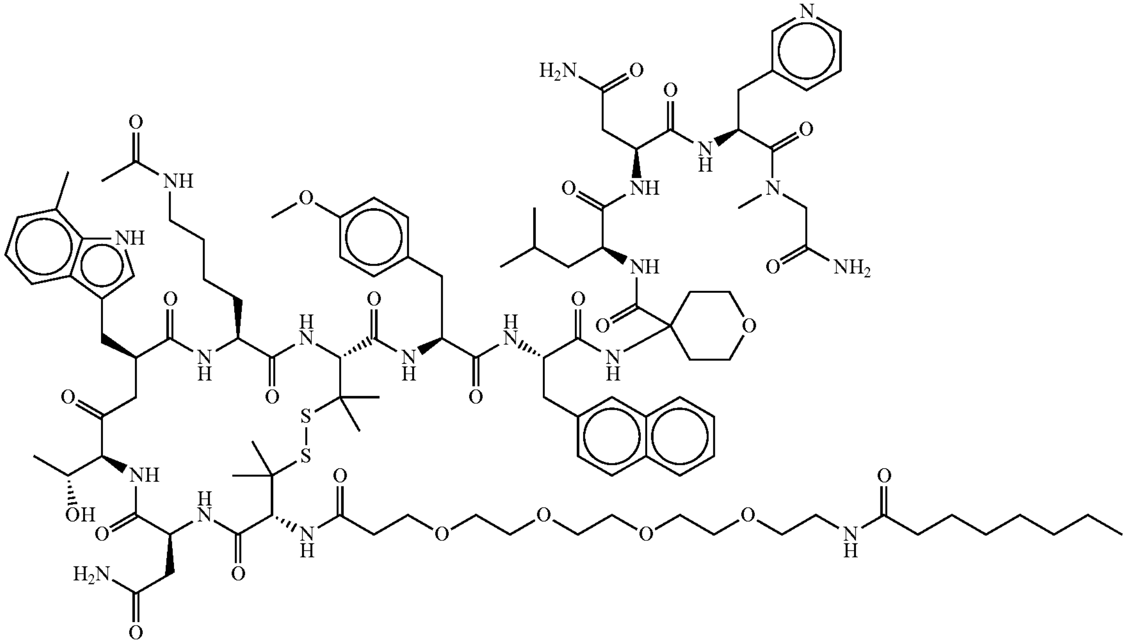 |

TABLE 1J-continued
| Compounds. | |
|---|---|
| SEQ ID. | Structure |
| 229 | [PEG4_Hexyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 287)<br>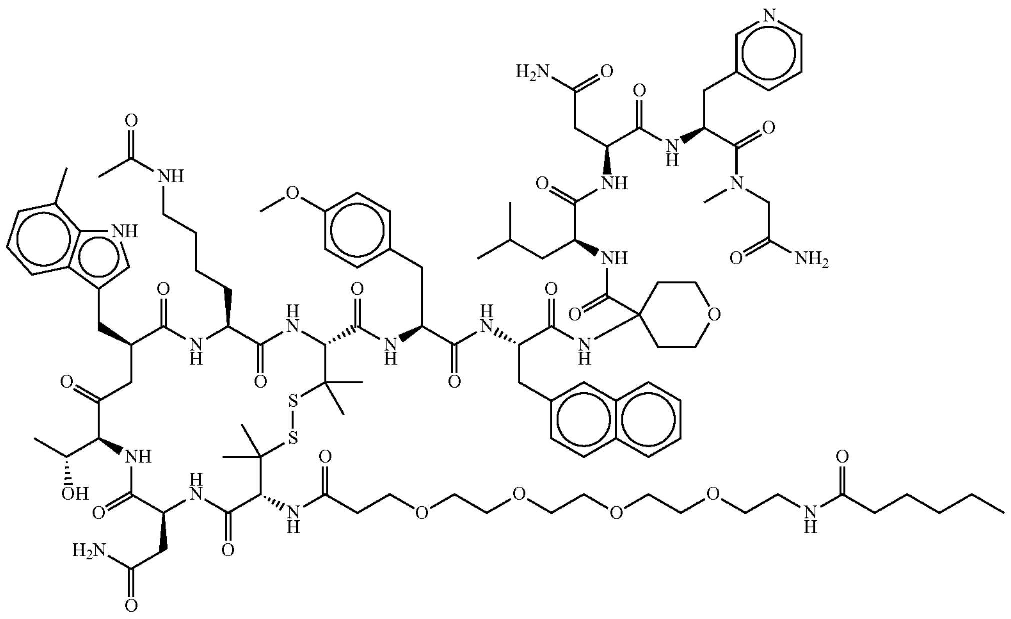 |

TABLE 1J-continued
| Compounds. | |
|---|---|
| SEQ ID. | Structure |
| 230 | [PEG2_Palm]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 288)<br>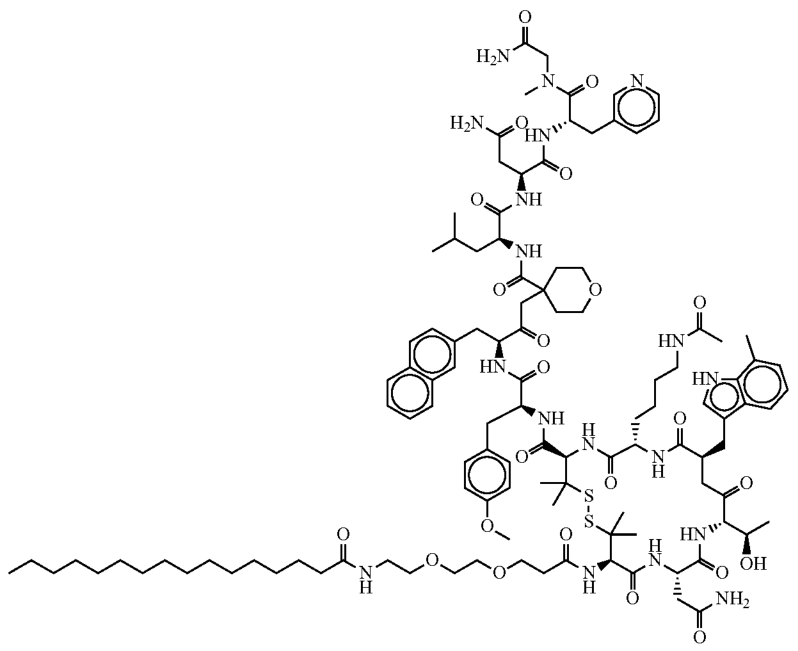 |

TABLE 1J-continued
| Compounds. | |
|---|---|
| SEQ ID. | Structure |
| 231 | [PEG2_Myristyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 289) 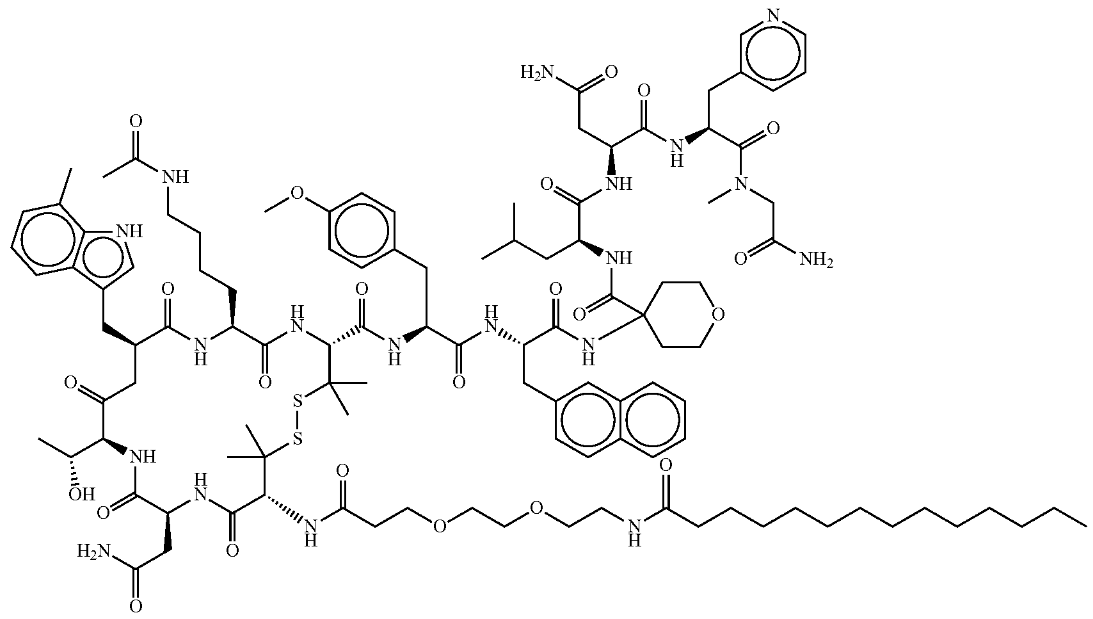 |

TABLE 1J-continued
| Compounds. | |
|---|---|
| SEQ ID. | Structure |
| 232 | [PEG2_Lauryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 290)<br>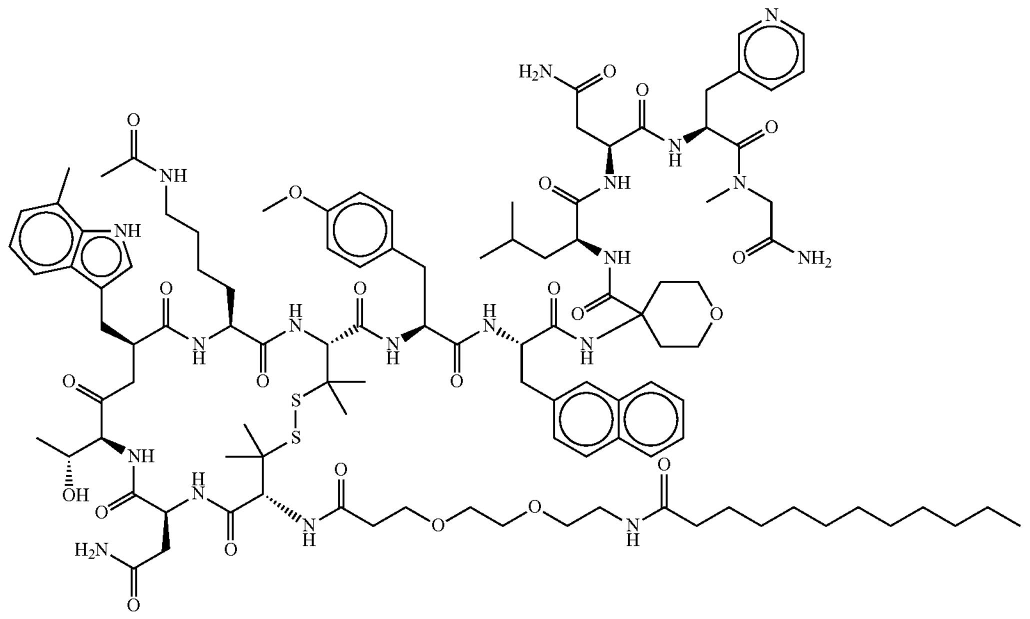 |

TABLE 1J-continued
| Compounds. | |
|---|---|
| SEQ ID. | Structure |
| 233 | [Hexyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 291) 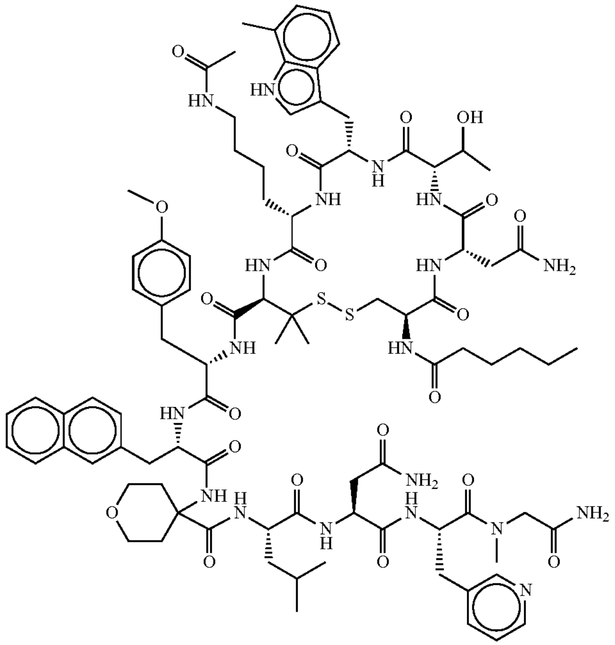 |

TABLE 1J-continued
| Compounds. | |
|---|---|
| SEQ ID. | Structure |
| 234 | [Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 292)<br>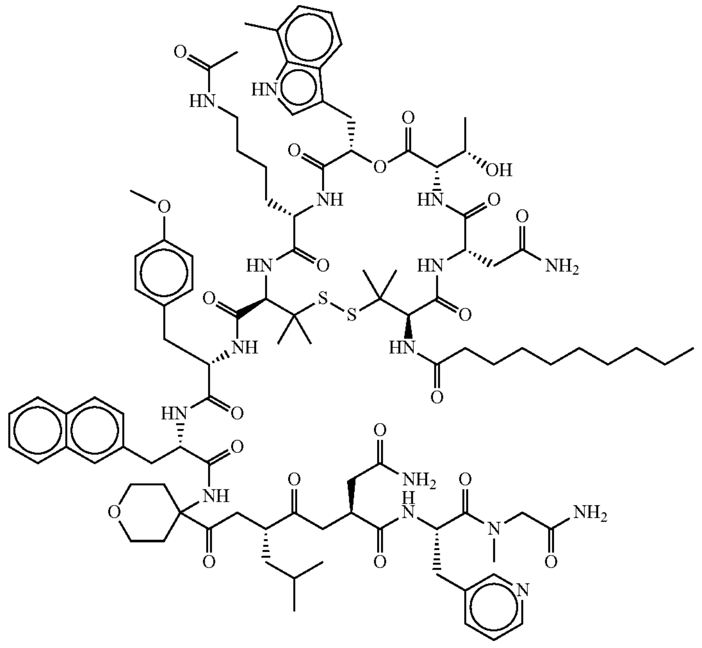 |

TABLE 1J-continued
| Compounds. | |
|---|---|
| SEQ ID. | Structure |
| 235 | [PEG2_Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 293) 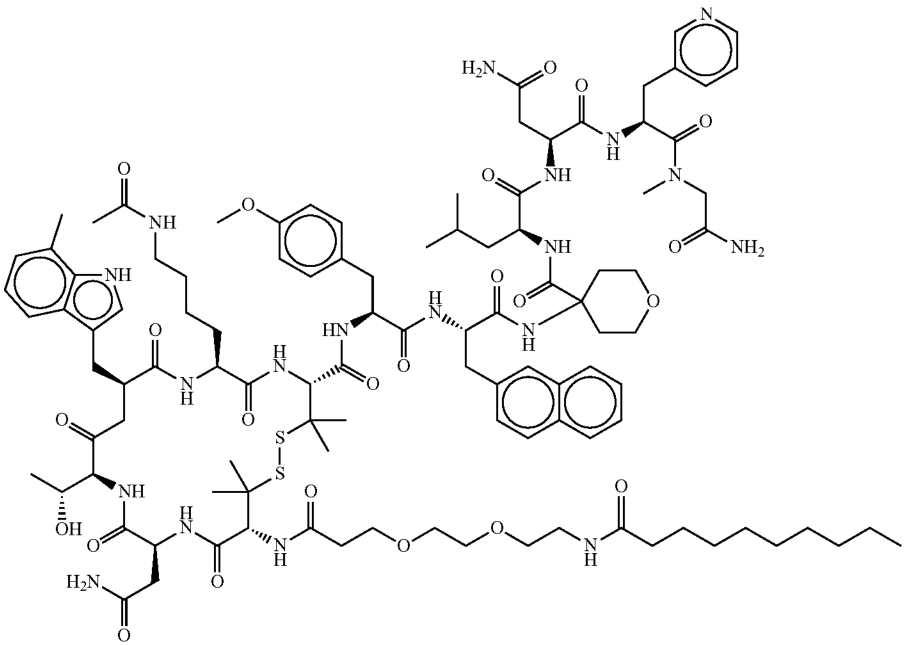 |

TABLE 1J-continued
| Compounds. | |
|---|---|
| SEQ ID. | Structure |
| 236 | [PEG2_Capryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 294) 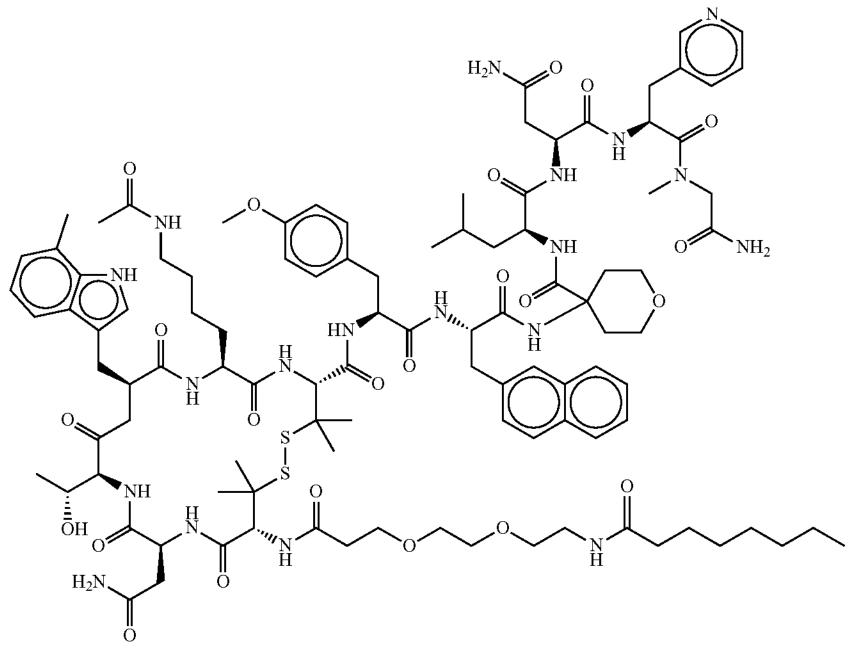 |

TABLE 1J-continued
| Compounds. | |
|---|---|
| SEQ ID. | Structure |
| 237 | [Oct]-[Pen]-N-T-[Trp(7-Me)]-[Lys(Ac)]-[Pen]-[Phe(4-OMe)]-[2Nal]-[THP]-L-N-[3Pal]-[Sarc]-NH2 (Example 295)<br>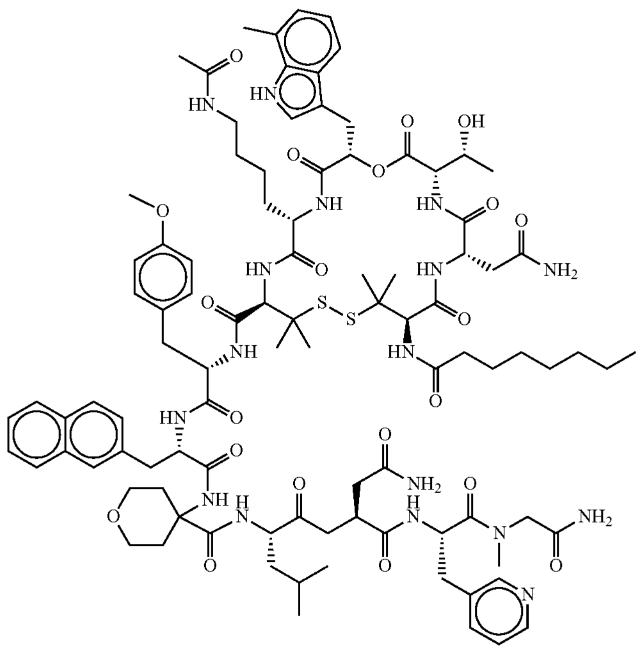 |

TABLE 1J-continued
| Compounds. | |
|---|---|
| SEQ ID. | Structure |
| 238 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4_IsoGlu_Palm)]-NH2 (Example 296) 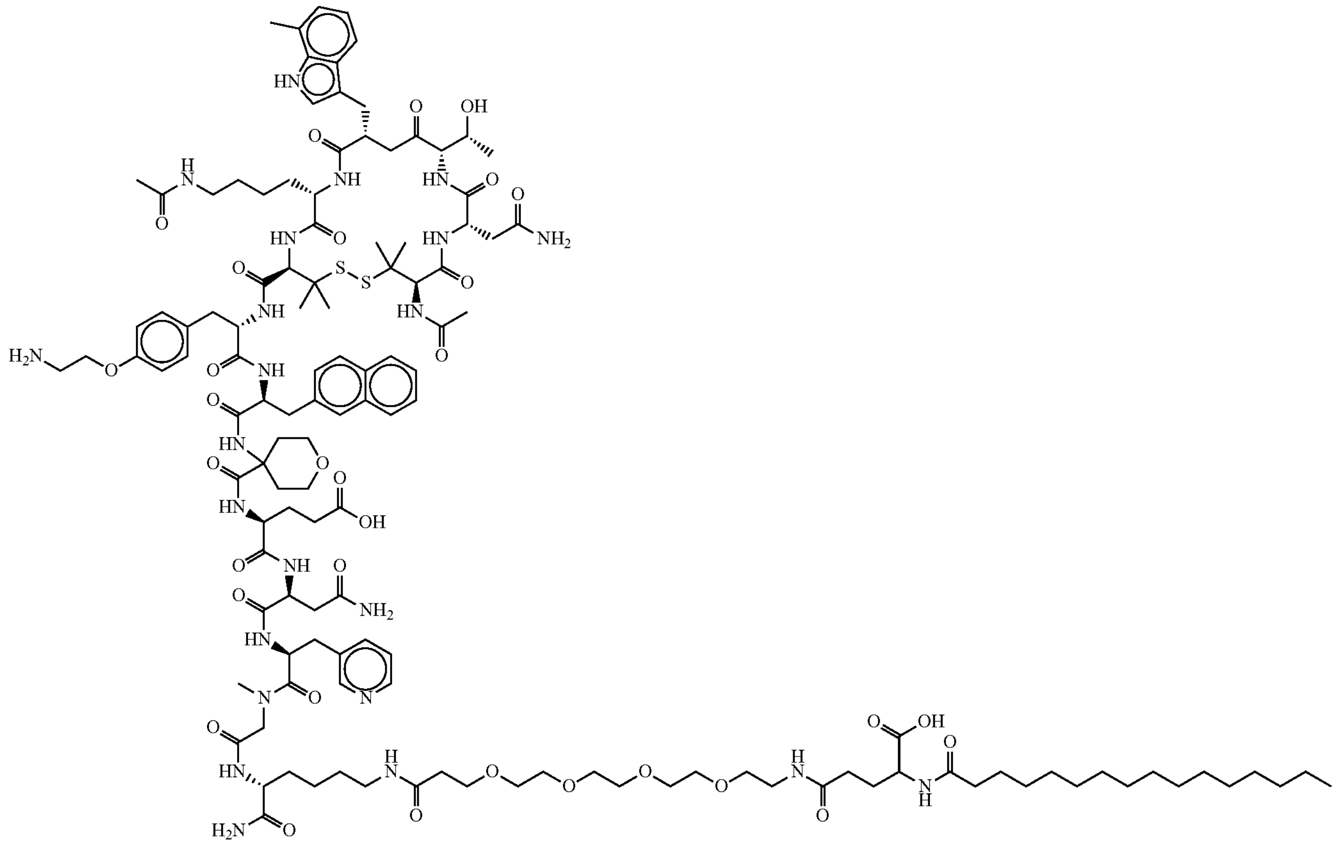 |

TABLE 1J-continued
| Compounds. | |
|---|---|
| SEQ ID. | Structure |
| 239 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(IsoGlu_Palm)]-NH2 (Example 297)<br>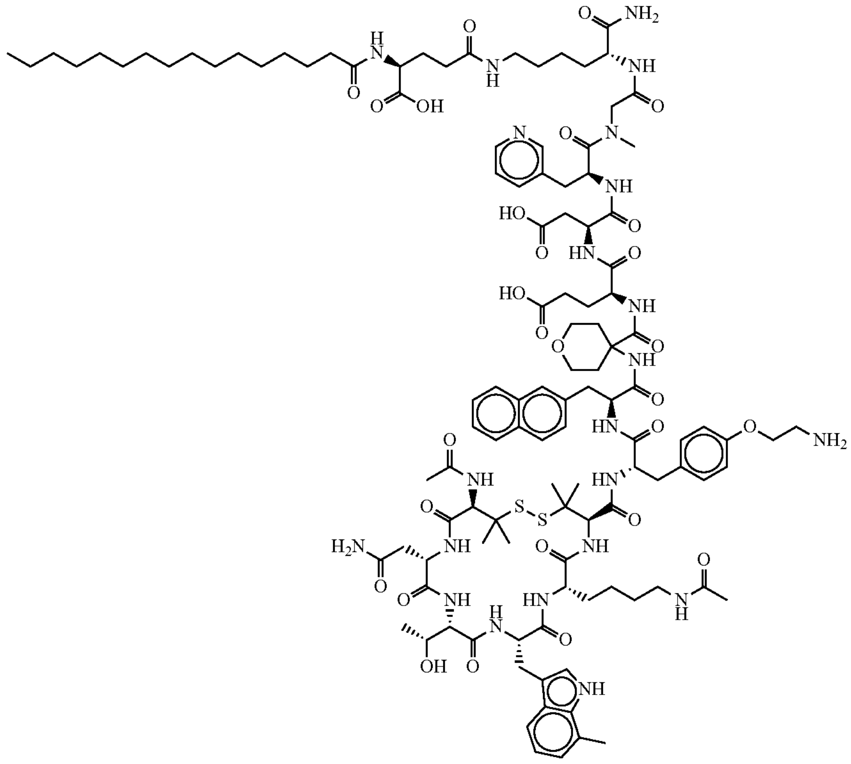 |

TABLE 1J-continued
| Compounds. | |
|---|---|
| SEQ ID. | Structure |
| 240 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12_C18_Diacid)]-NH2<br>(Example 298)<br>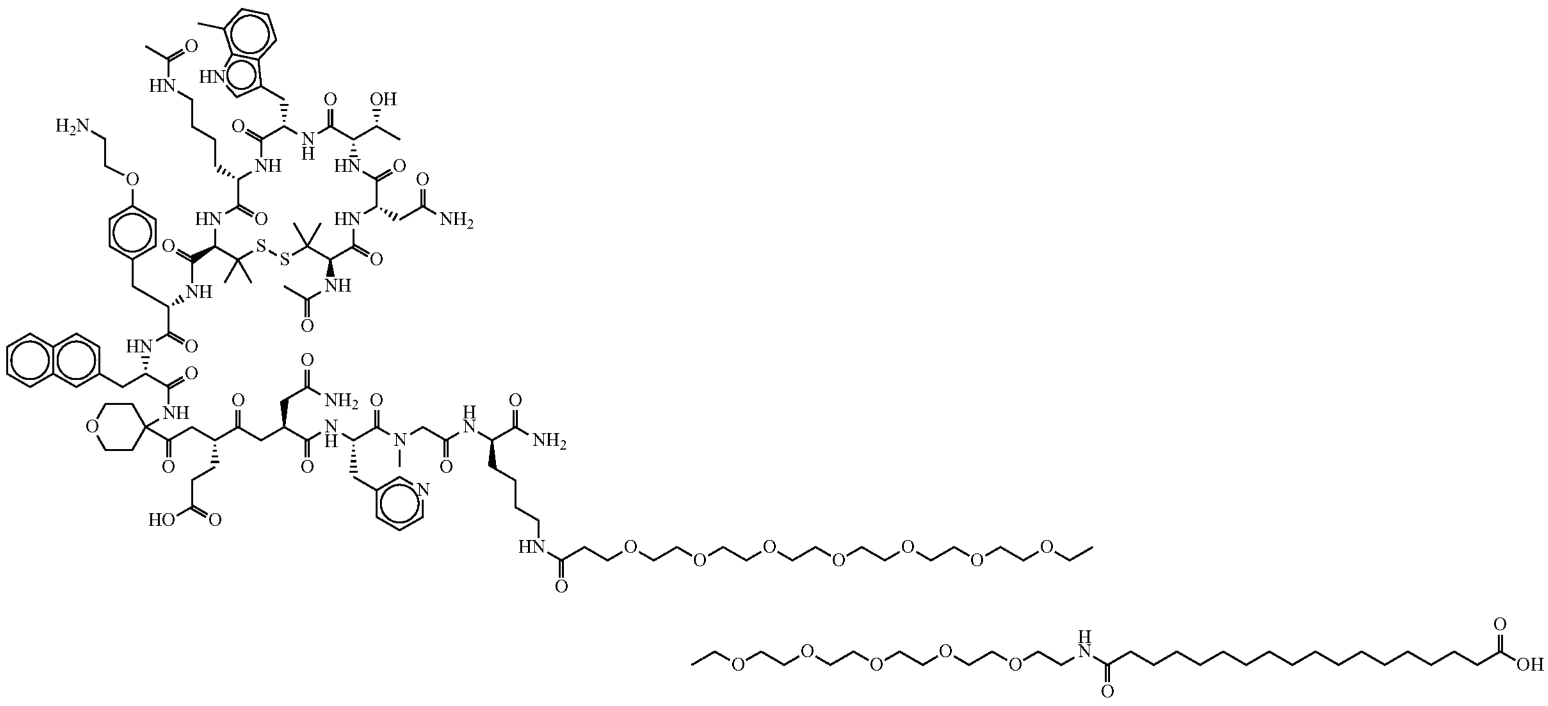 |

TABLE 1J-continued
| Compounds. | |
| --- | --- |
| SEQ ID. | Structure |
| 241 | Ac-[Pen]-N-T-[Trp(7-Me)]-[Lys(Ac)]-[Pen]-[Phe(4-CONH2)]-[2Nal]-[aMeLys(Peg4_IsoGlu_C18_Diacid)]-[Lys(Ac)]-N-[3Pal]-[Sarc]-NH2 (Example 299) 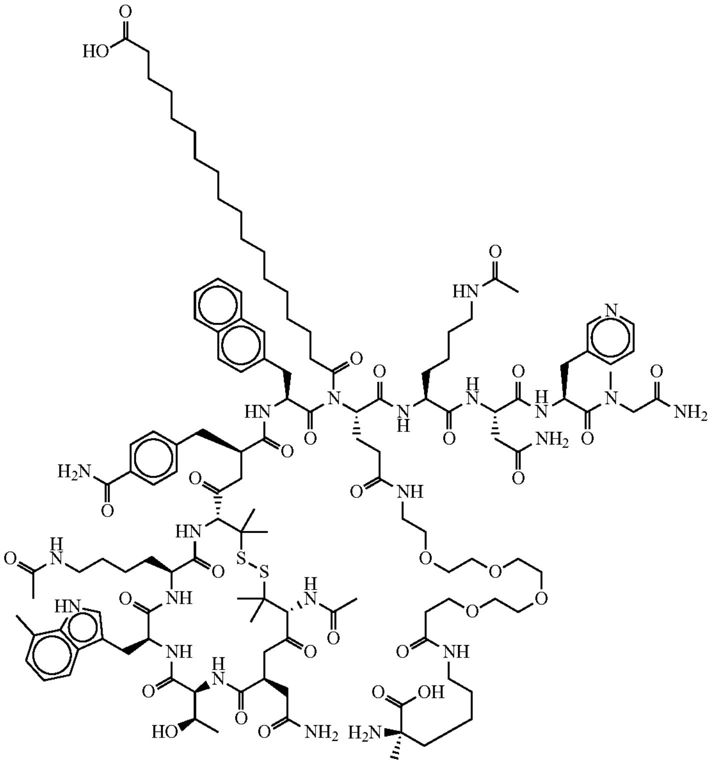 |

TABLE 1J-continued
| Compounds. | |
|---|---|
| SEQ ID. | Structure |
| 242 | Ac-[Pen]-N-T-[Trp(7-Me)]-[Lys(Ac)]-[Pen]-[Phe(4-CONH2)]-[2Nal]-[aMeLys(PEG12_C18_Diacid)]-[Lys(Ac)]-N-[3Pal]-[Sarc]-NH2 (Example 300) 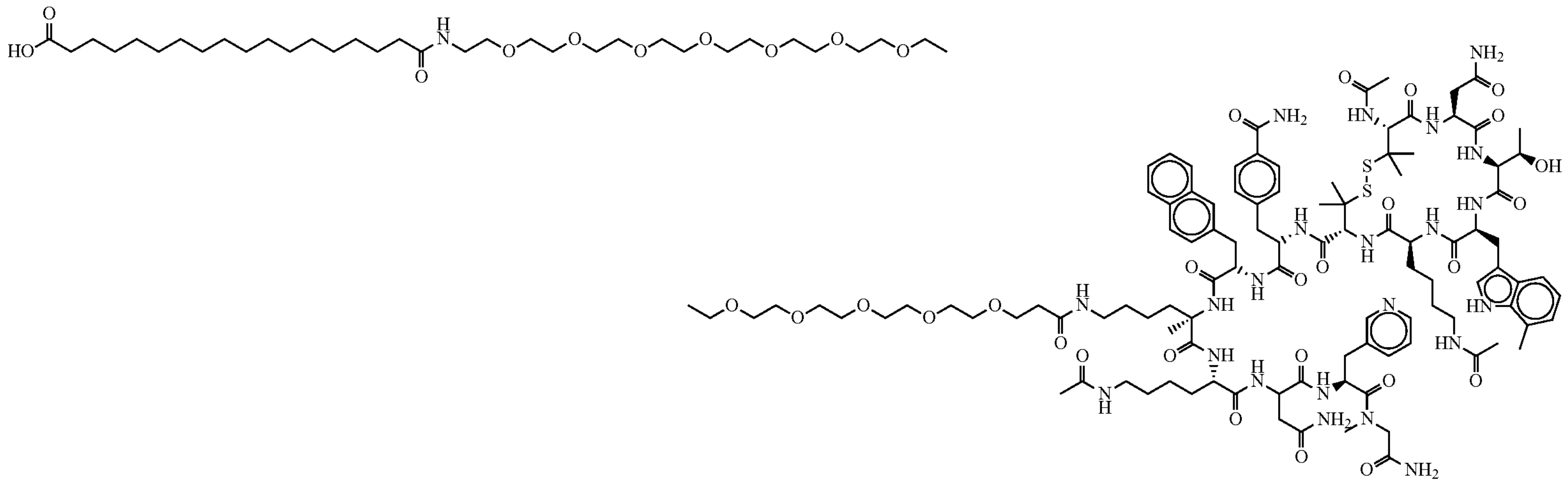 |

TABLE 1K
| Compounds. | |
|---|---|
| SEQ ID. | Structure |
| 243 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12_IsoGlu_Palm)]-[3Pal]-[Sarc]-NH2 (Example 301)<br>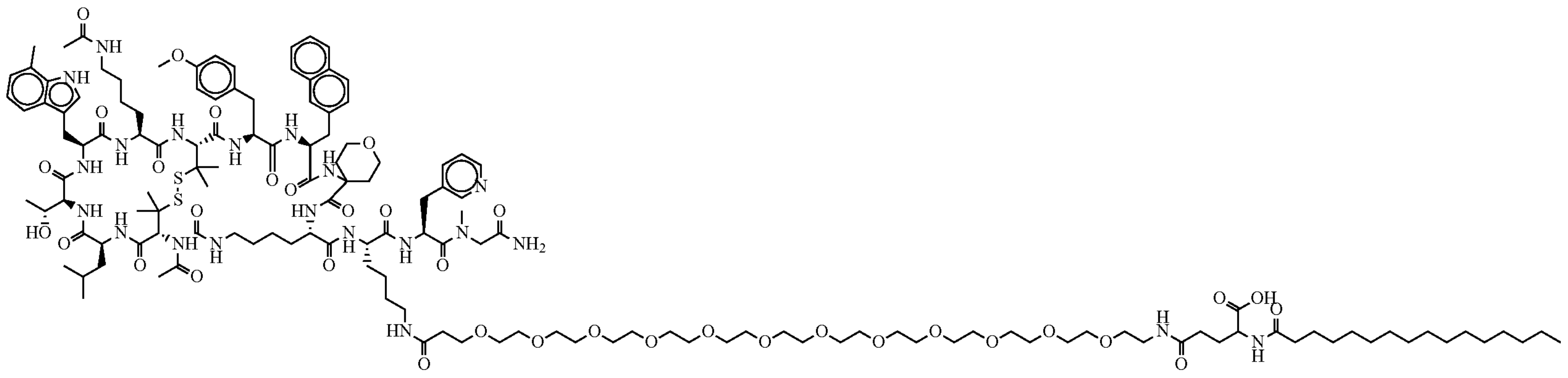 |

TABLE 1K-continued
| Compounds. | |
|---|---|
| SEQ ID. | Structure |
| 244 | [PEG2_Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 302)<br>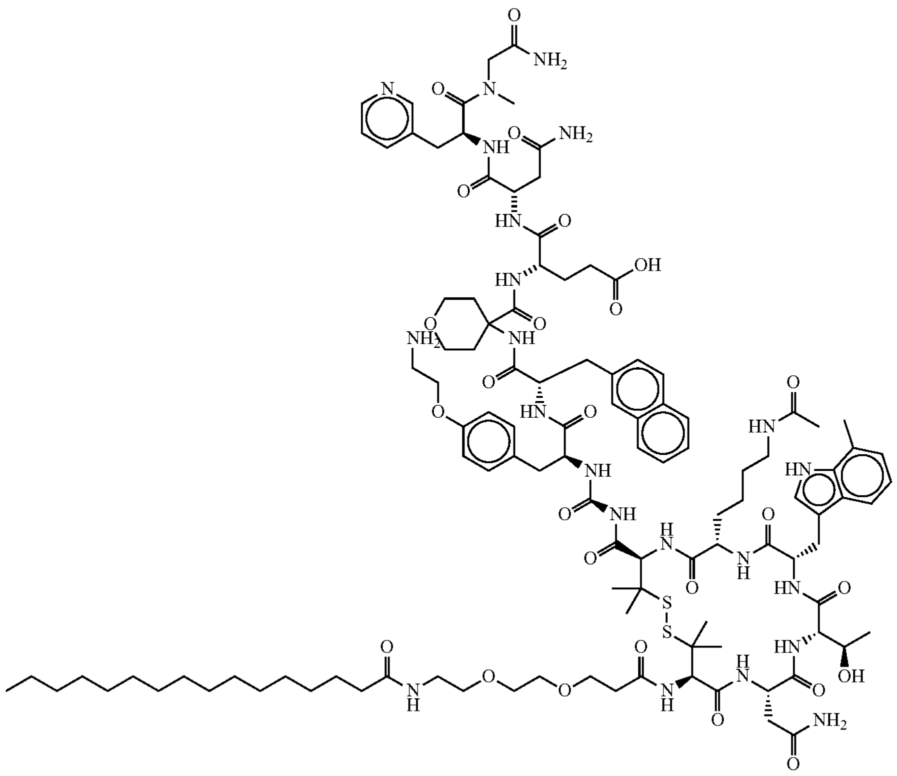 |

TABLE 1K-continued
| Compounds. | |
|---|---|
| SEQ ID. | Structure |
| 245 | [PEG2_Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2<br>(Example 303)<br>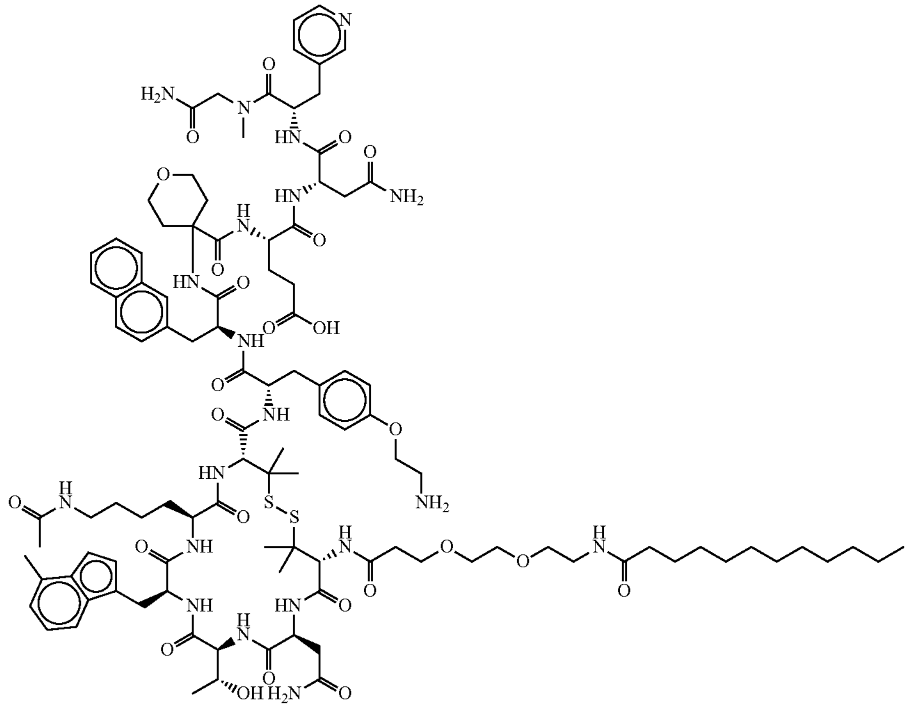 |

TABLE 1K-continued
| Compounds. | |
|---|---|
| SEQ ID. | Structure |
| 246 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4_IsoGlu_C18_Diacid)]-NH2 (Example 304) 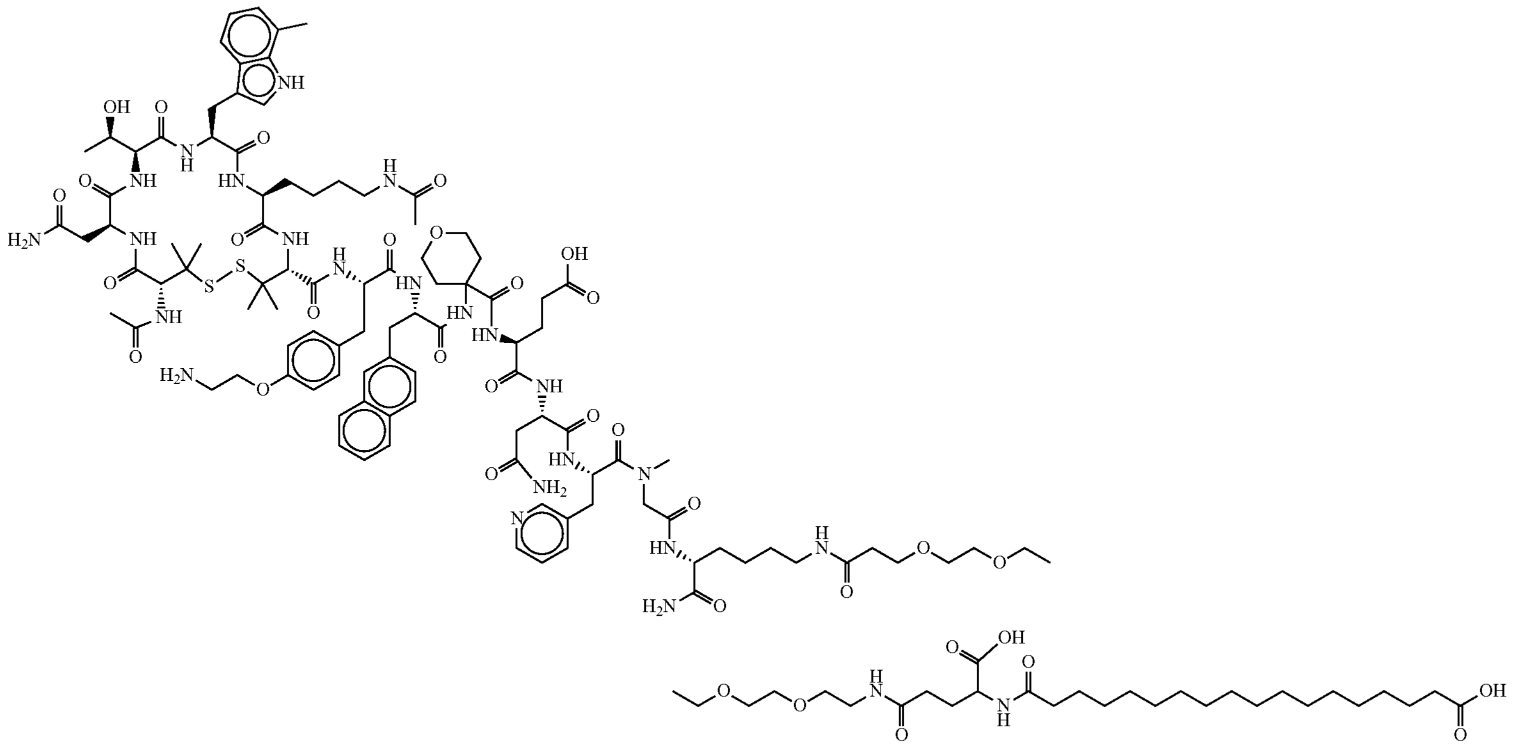 |

TABLE 1K-continued
| Compounds. | |
|---|---|
| SEQ ID. | Structure |
| 247 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12_IsoGlu_Palm)]-NH2 (Example 305) 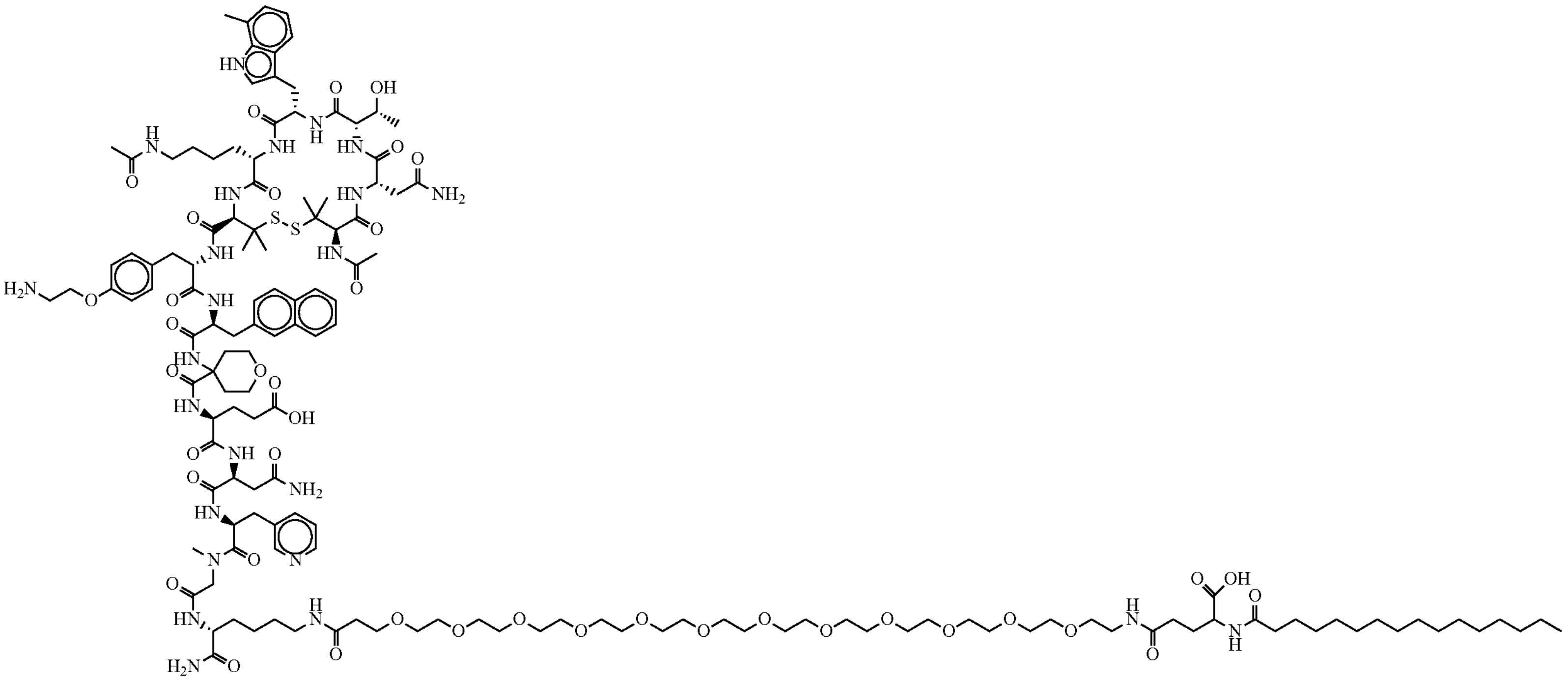 |

TABLE 1K-continued
| Compounds. | |
|---|---|
| SEQ ID. | Structure |
| 248 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4_C18_Diacid)]-NH2 (Example 306) 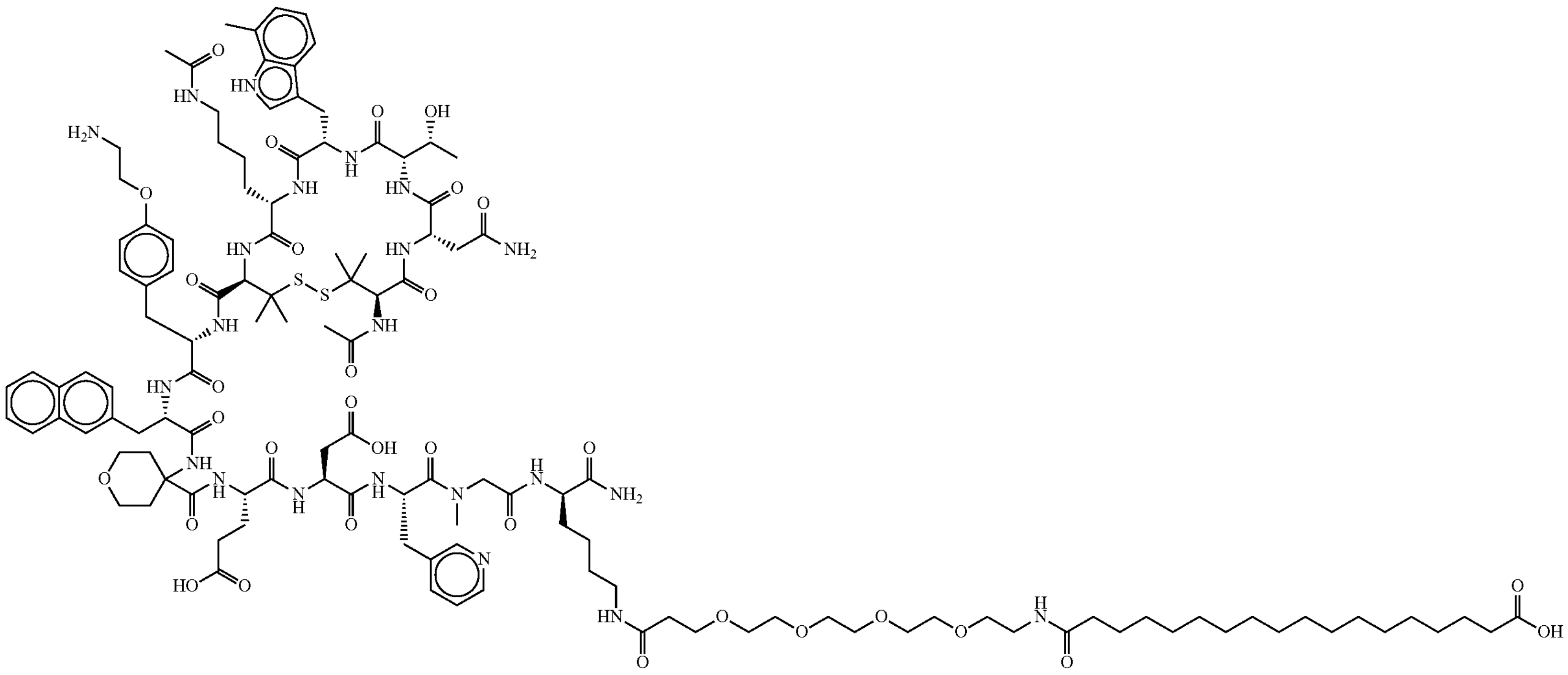 |

TABLE 1K-continued
| Compounds. | |
|---|---|
| SEQ ID. | Structure |
| 249 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(IsoGlu_C18_Diacid)]-NH2 (Example 307) 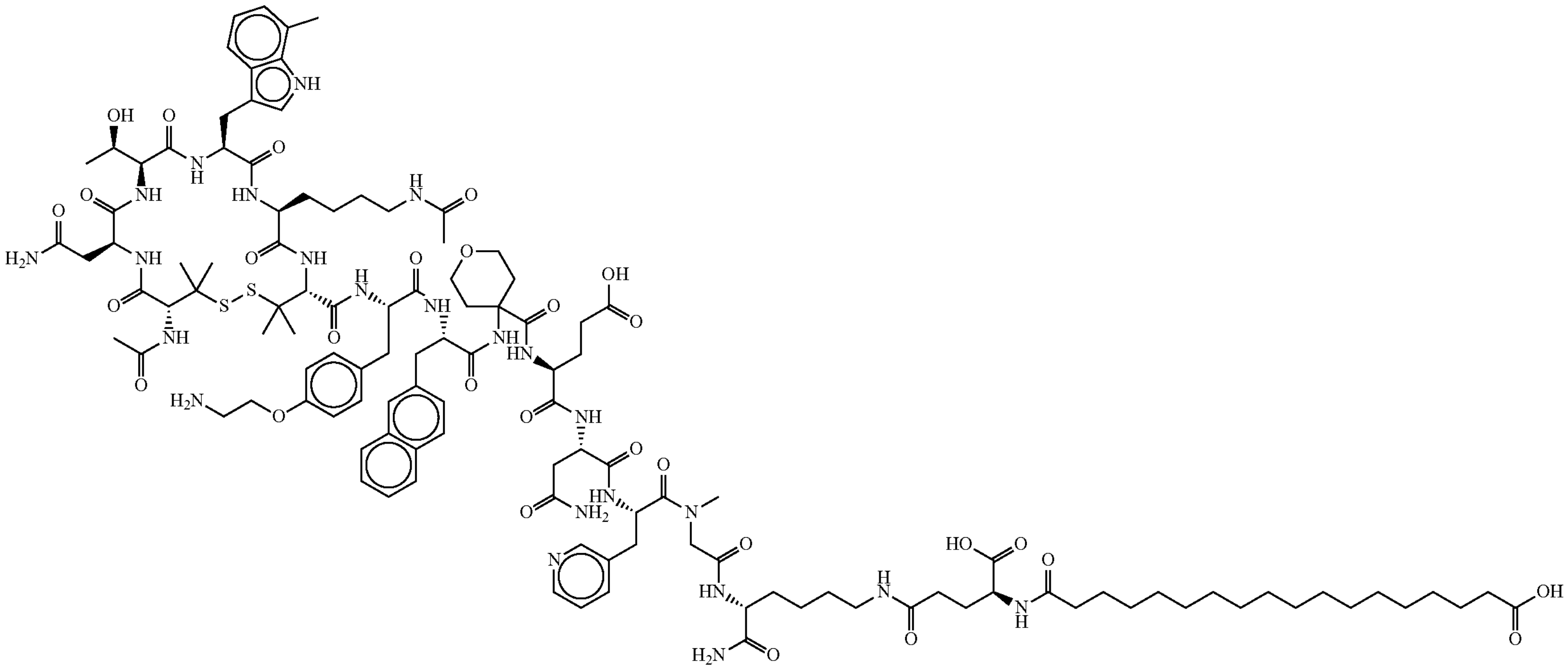 |

TABLE 1K-continued
| Compounds. | |
|---|---|
| SEQ ID. | Structure |
| 250 | [PEG4_Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2<br>(Example 308)<br>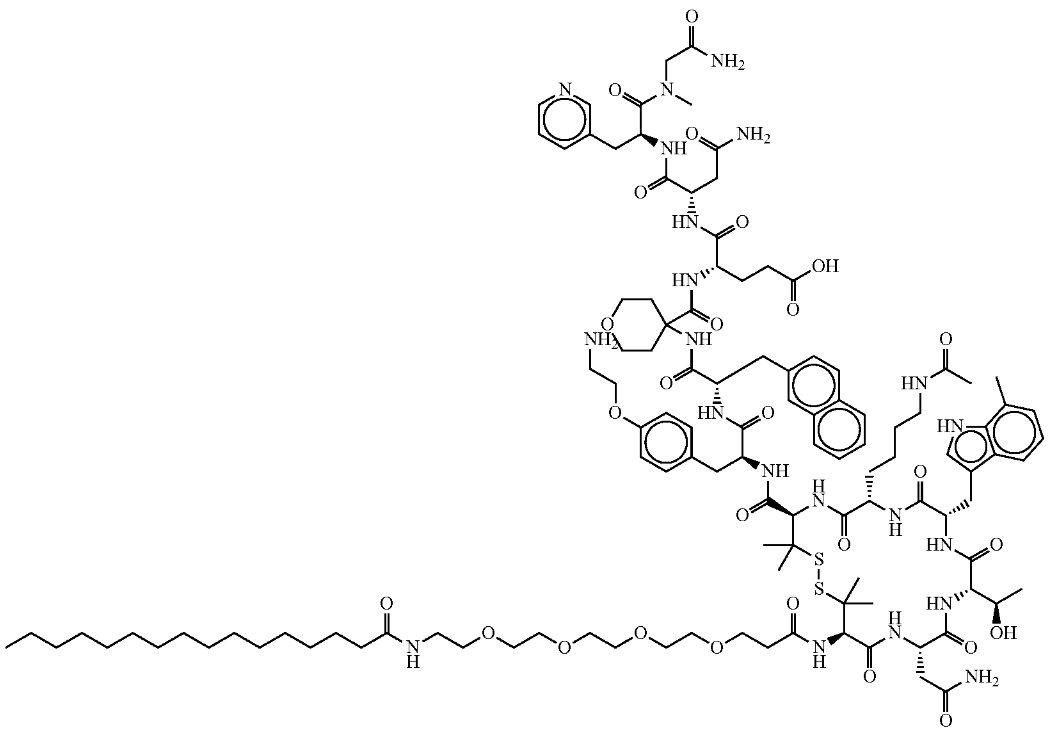 |

TABLE 1K-continued
| Compounds. | |
|---|---|
| SEQ ID. | Structure |
| 251 | [Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 309)<br>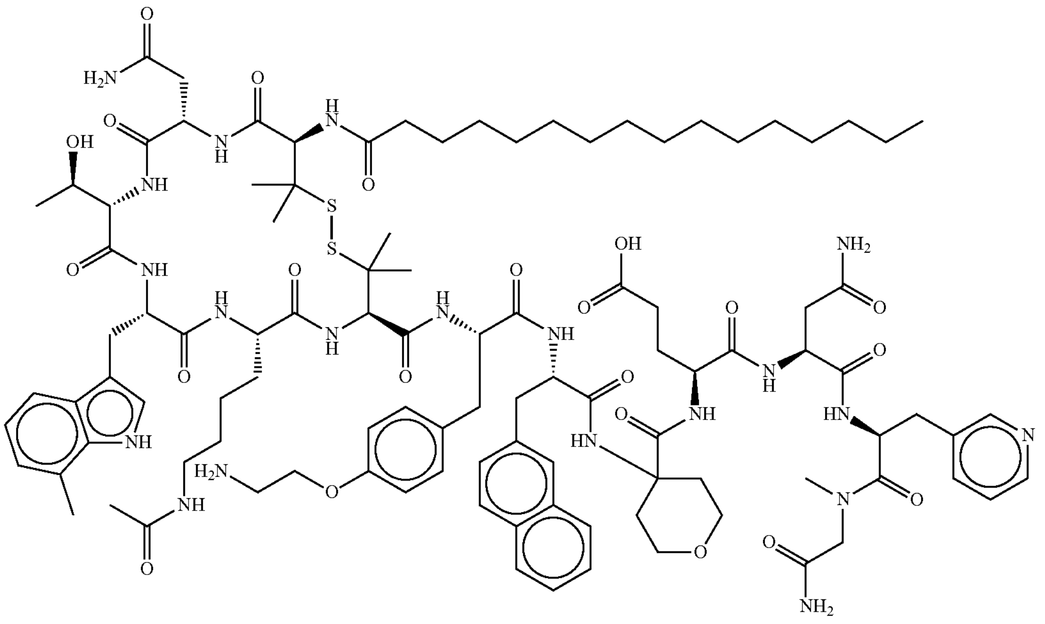 |

TABLE 1K-continued
| Compounds. | |
|---|---|
| SEQ ID. | Structure |
| 252 | [Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 310)<br>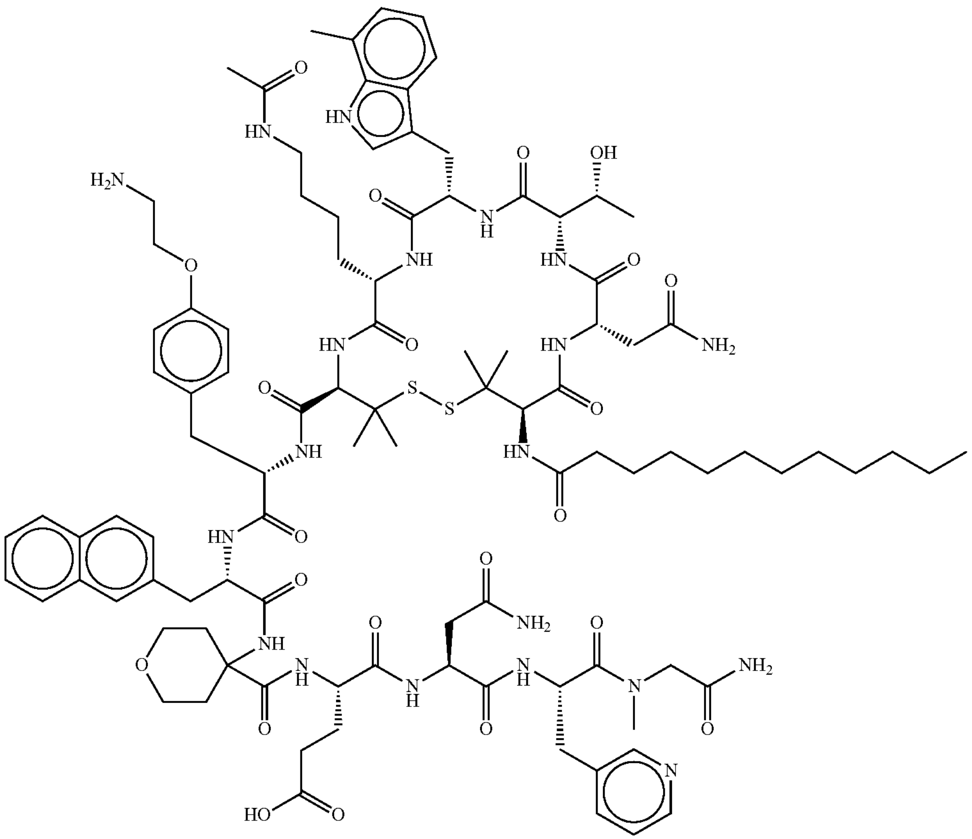 |

TABLE 1K-continued
| Compounds. | |
|---|---|
| SEQ ID. | Structure |
| 253 | [Oct]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 311)<br>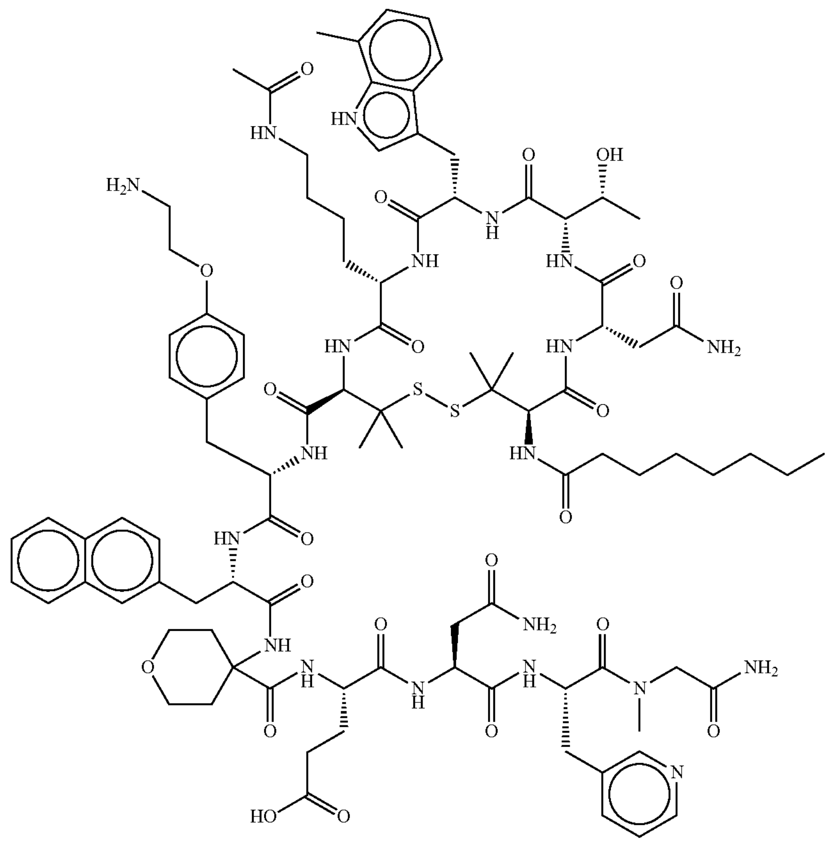 |

TABLE 1K-continued
| Compounds. | |
|---|---|
| SEQ ID. | Structure |
| 254 | [PEG4_Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2<br>(Example 312)<br>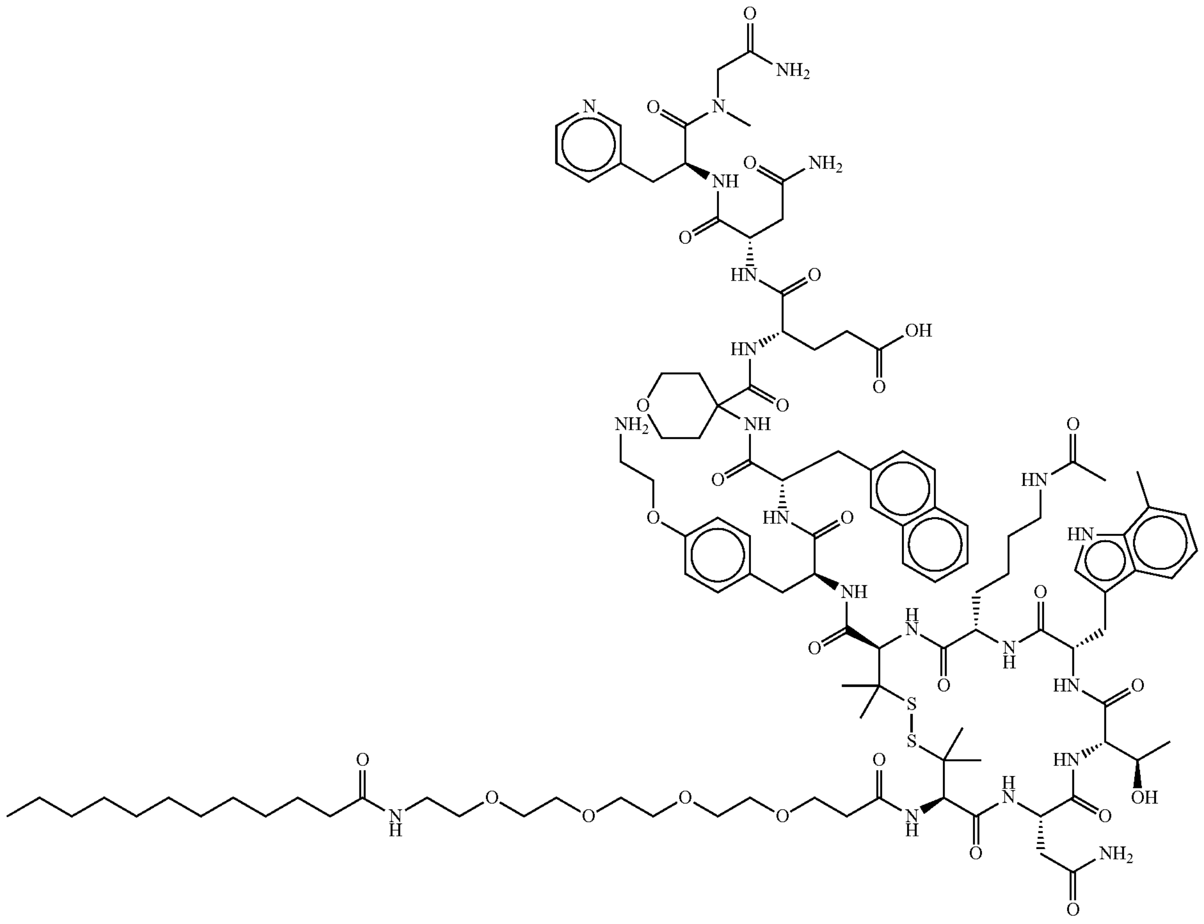 |

TABLE 1K-continued
| Compounds. | |
|---|---|
| SEQ ID. | Structure |
| 255 | [PEG4_Capryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2<br>(Example 313)<br>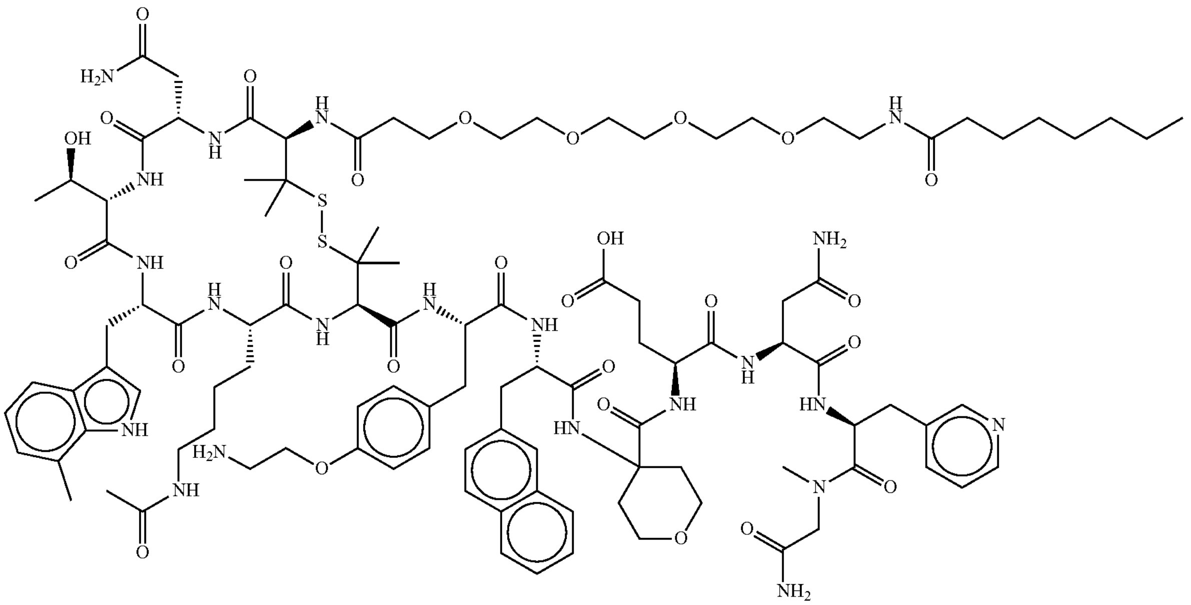 |

TABLE 1K-continued
| Compounds. | |
|---|---|
| SEQ ID. | Structure |
| 256 | [PEG4_Hexyl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 314) 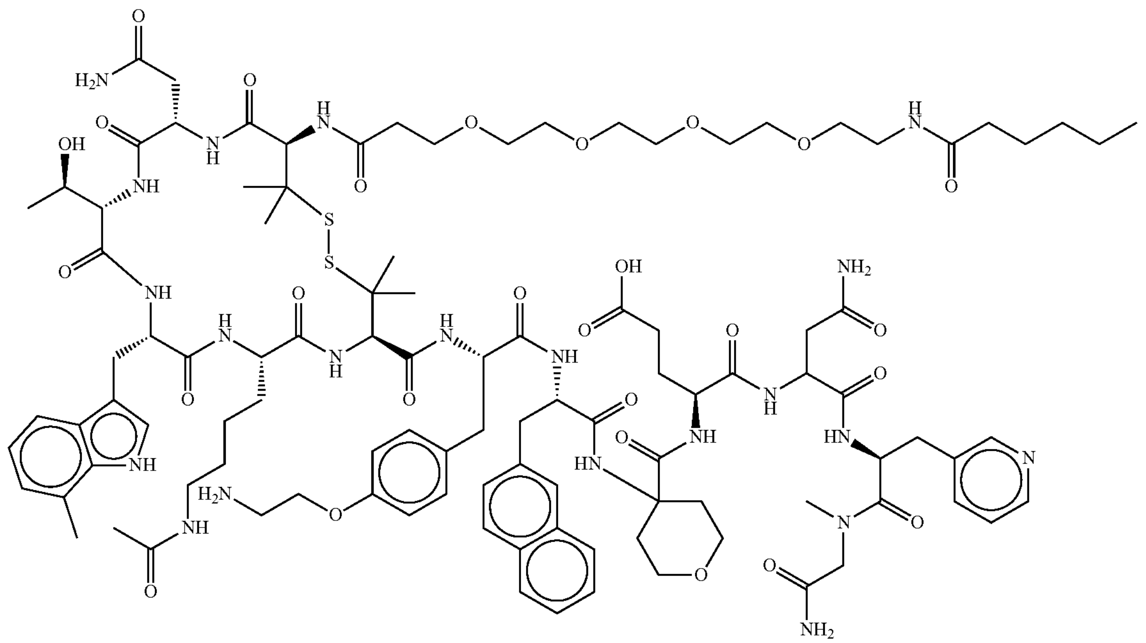 |

TABLE 1K-continued
| Compounds. | |
|---|---|
| SEQ ID. | Structure |
| 257 | Ac-[Pen]-N-T-[Trp(7-Me)]-[Lys(Ac)]-[Pen]-[Phe(4-CONH2)]-[2Nal]-[aMeLys(PEG12_IsoGlu_C18_Diacid)]-[Lys(Ac)]-N-[3Pal]-[Sarc]-NH2 (Example 315) 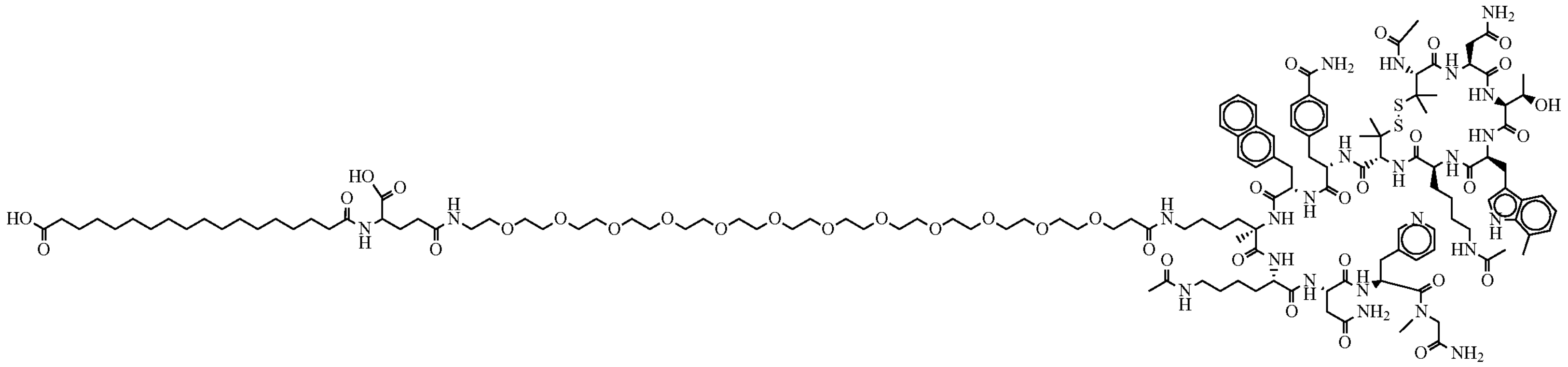 |
| 258 | Ac-[Pen]-N-T-[Trp(7-Me)]-[Lys(Ac)]-[Pen]-[Phe(4-CONH2)]-[2Nal]-[aMeLys(PEG12_IsoGlu_Palm)]-[Lys(Ac)]-N-[3Pal]-[Sarc]-NH2 (Example 316) 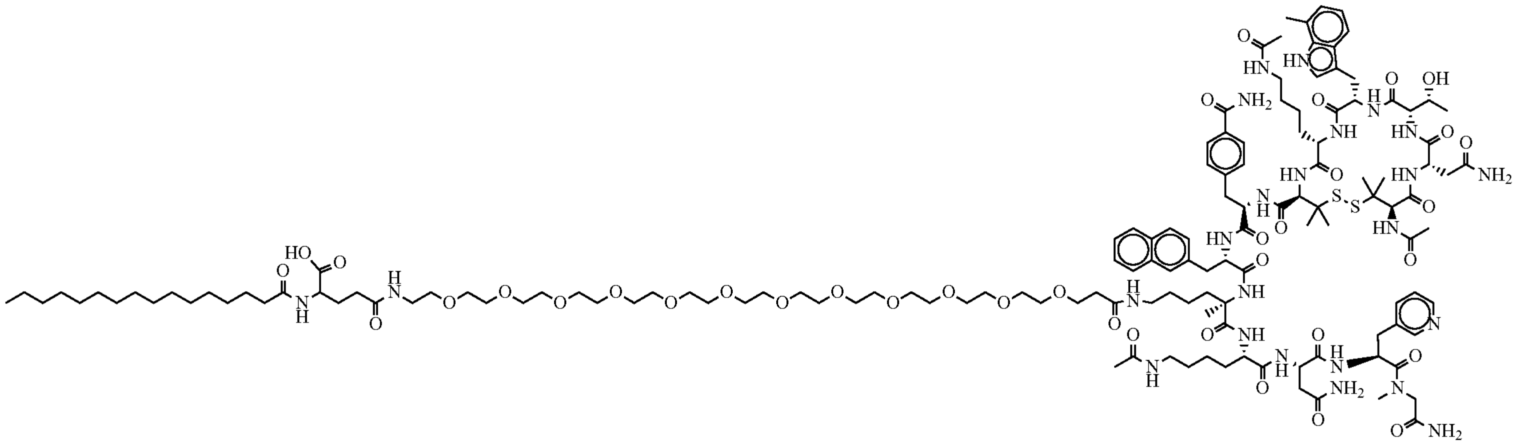 |

TABLE 1K-continued
| Compounds. | |
|---|---|
| SEQ ID. | Structure |
| 259 | Ac-[Pen]-N-T-[Trp(7-Me)]-[Lys(Ac)]-[Pen]-[Phe(4-CONH2)]-[2Nal]-[aMeLys(Peg4_IsoGlu_Palm)]-[Lys(Ac)]-N-[3Pal]-[Sarc]-NH2 (Example 317) 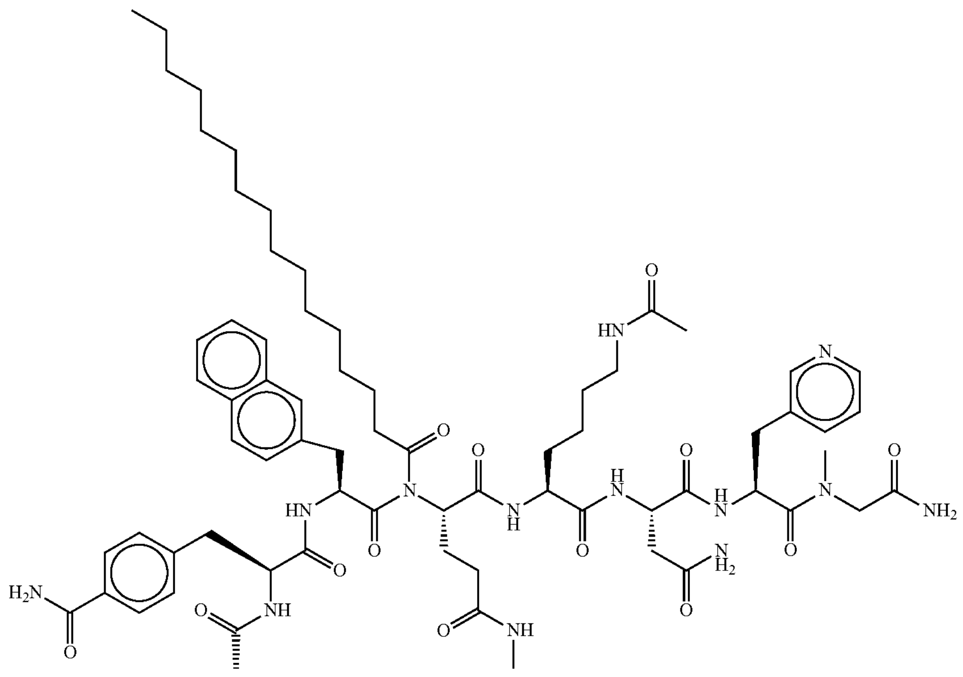 |

TABLE 1K-continued
| Compounds. | |
|---|---|
| SEQ ID. | Structure |
| | 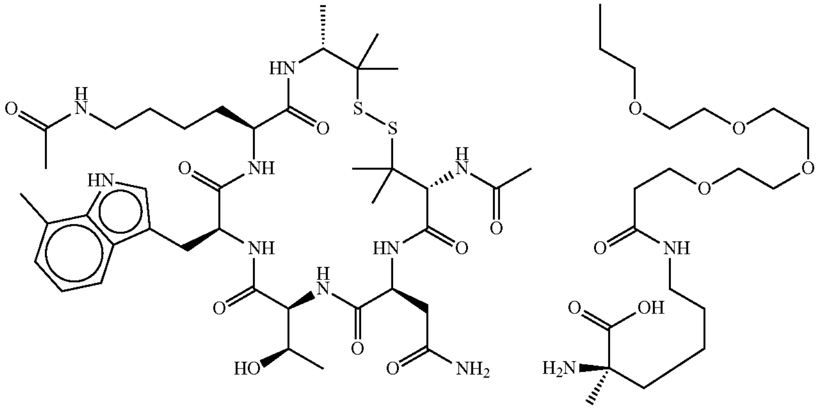 |

TABLE 1K-continued
| Compounds. | |
|---|---|
| SEQ ID. | Structure |
| 260 | Ac-[Pen]-N-T-[Trp(7-Me)]-[Lys(Ac)]-[Pen]-[Phe(4-CONH2)]-[2Nal]-[aMeLys(IsoGlu_Palm)]-[Lys(Ac)]-N-[3Pal]-[Sarc]-NH2 (Example 318) 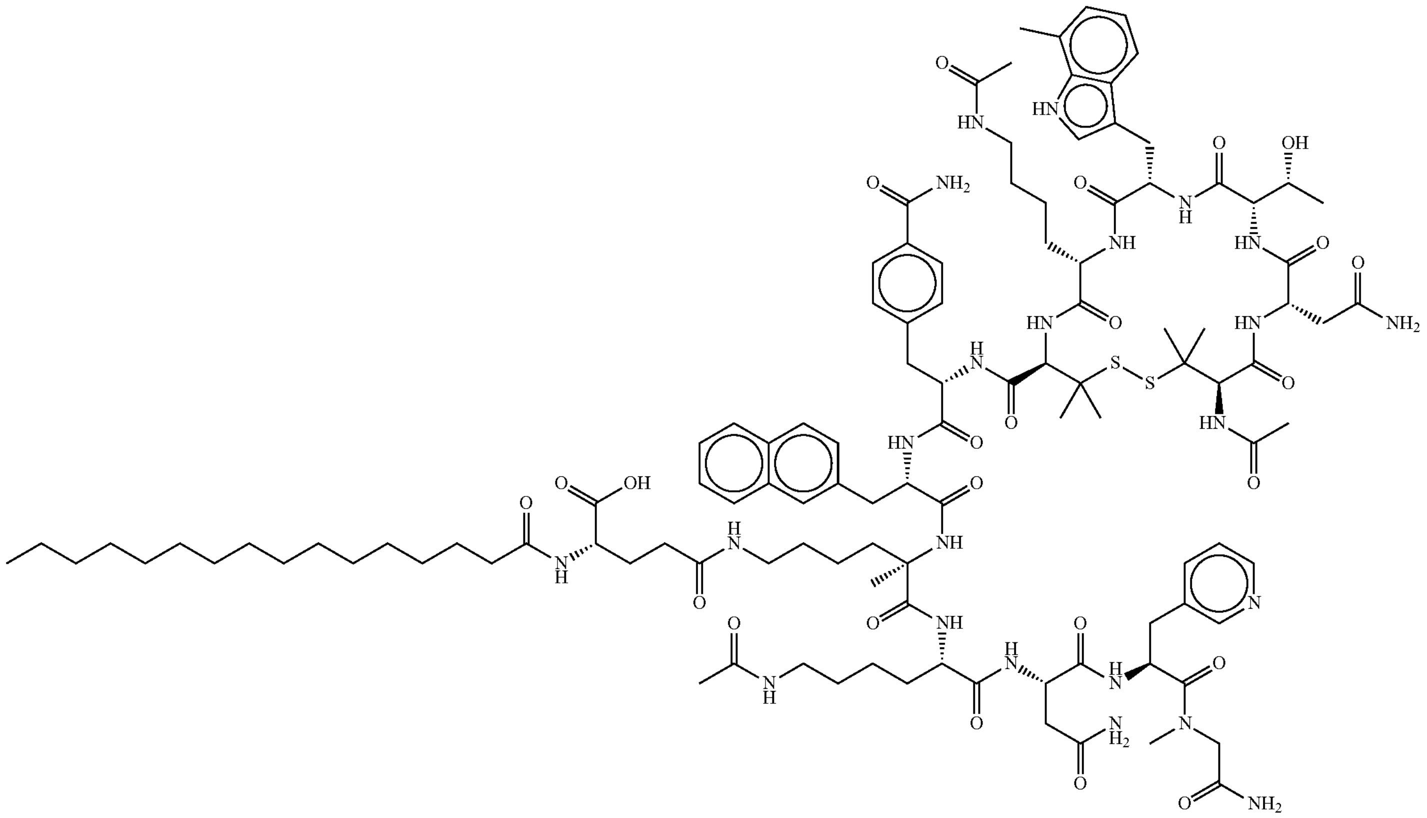 |

TABLE 1K-continued
| Compounds. | |
|---|---|
| SEQ ID. | Structure |
| 261 | Ac-[Pen]-N-T-[Trp(7-Me)]-[Lys(Ac)]-[Pen]-[Phe(4-CONH2)]-[2Nal]-[aMeLys(IsoGlu_C18_Diacid)]-[Lys(Ac)]-N-[3Pal]-[Sarc]-NH2 (Example 319) 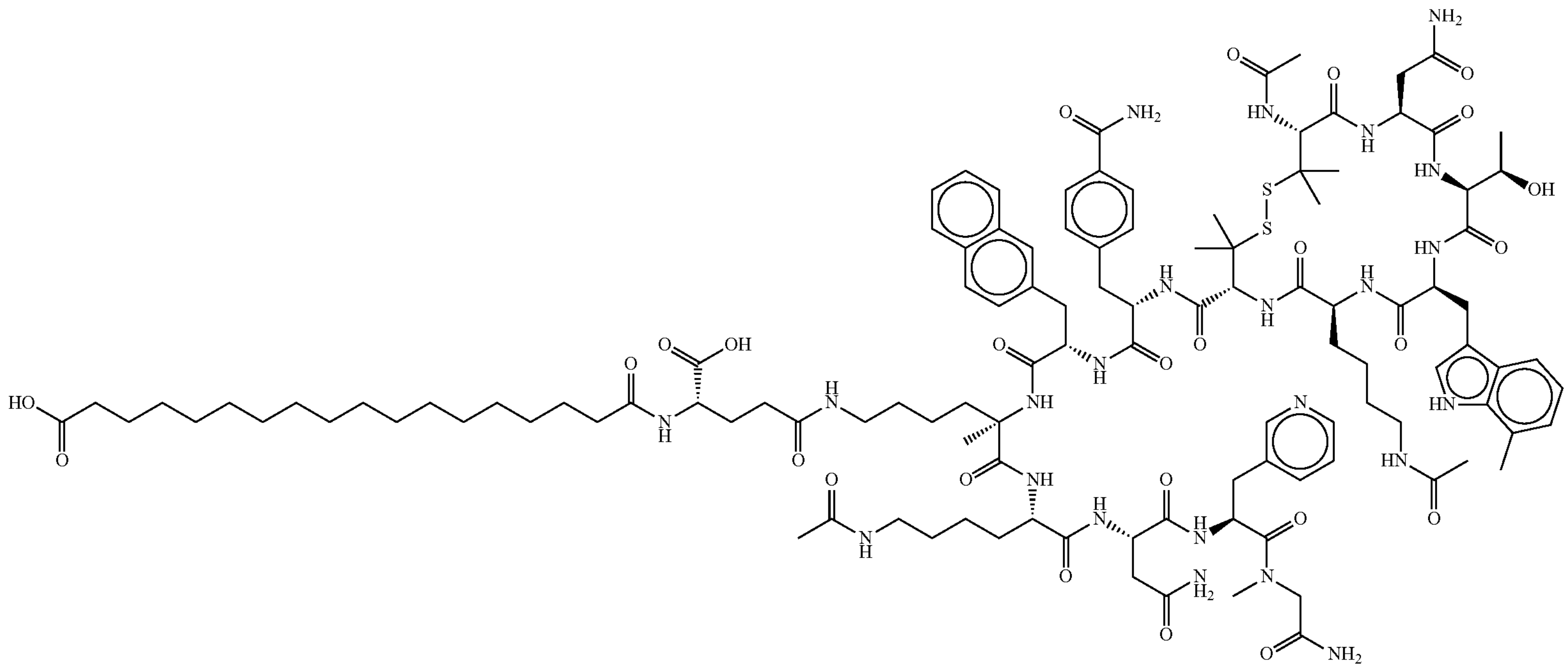 |

TABLE 1K-continued
| Compounds. | |
|---|---|
| SEQ ID. | Structure |
| 262 | Ac-[Pen]-N-T-[Trp(7-Me)]-[Lys(Ac)]-[Pen]-[Phe(4-CONH2)]-[2Nal]-[aMeLys(Peg4_C18_Diacid)]-[Lys(Ac)]-N-[3Pal]-[Sarc]-NH2 (Example 320)<br>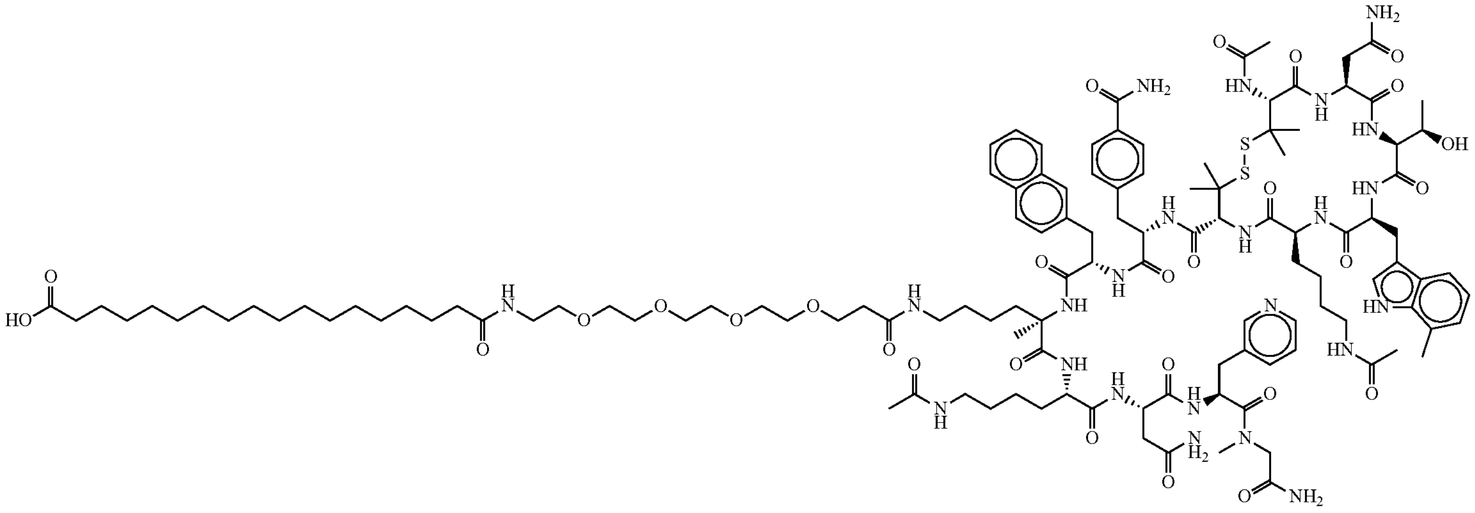 |

TABLE 1K-continued
| Compounds. | |
|---|---|
| SEQ ID. | Structure |
| 24 | [1PEG2_1PEG2_IsoGlu_C16_Diacid]-[(D)Arg]-[Pen]-N-T-[Trp(7-Me)]-[Lys(Ac)]-[Pen]-[Phe(4-(2-aminoethoxy))]-[2Nal]-[THP]-[Lys(Ac)]-N-[3Pal]-[Sarc]-NH2 (Example 321)<br>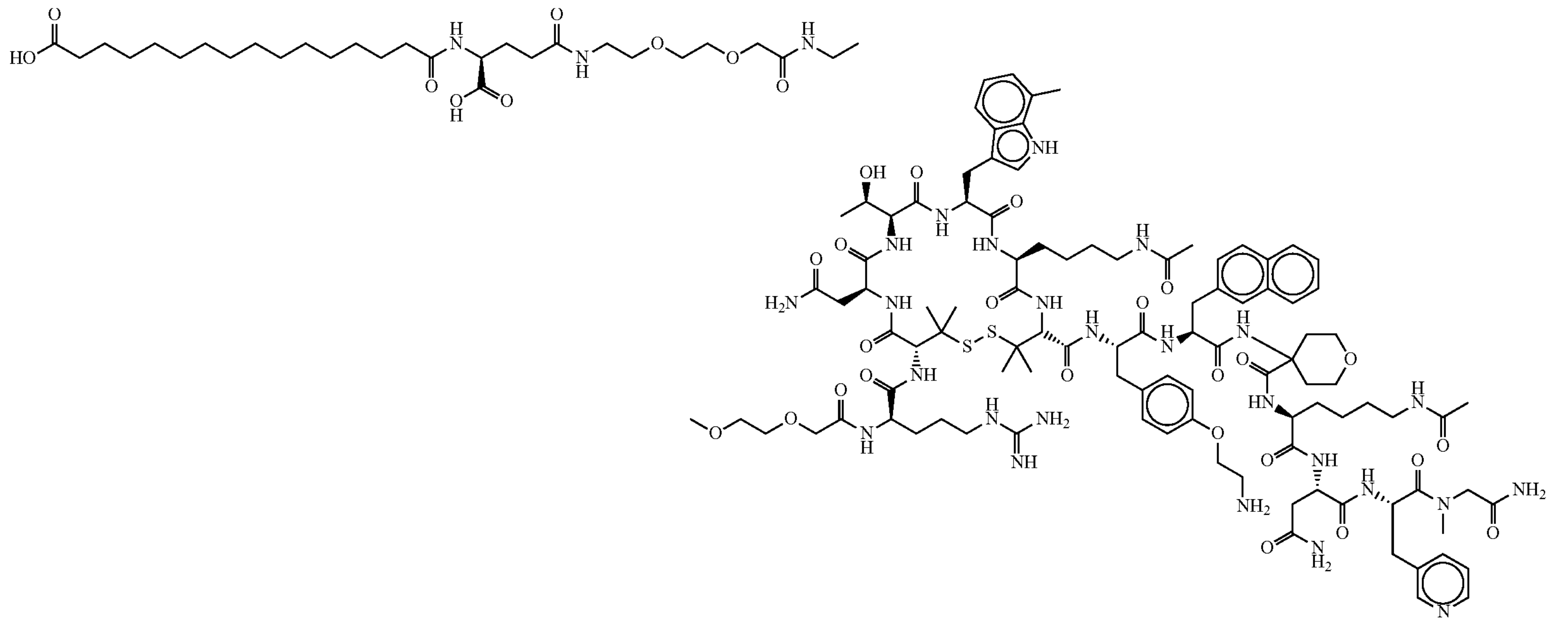 |

TABLE 1K-continued
| Compounds. | |
|---|---|
| SEQ ID. | Structure |
| 11 | [1PEG2_1PEG2_IsoGlu_C18_Diacid]-[(D)Arg]-[Pen]-N-T-[Trp(7-Me)]-[Lys(Ac)]-[Pen]-[Phe(4-(2-aminoethoxy))]-[2Nal]-[THP]-[Lys(Ac)]-N-[3Pal]-[Sarc]-NH2 (Example 322)<br>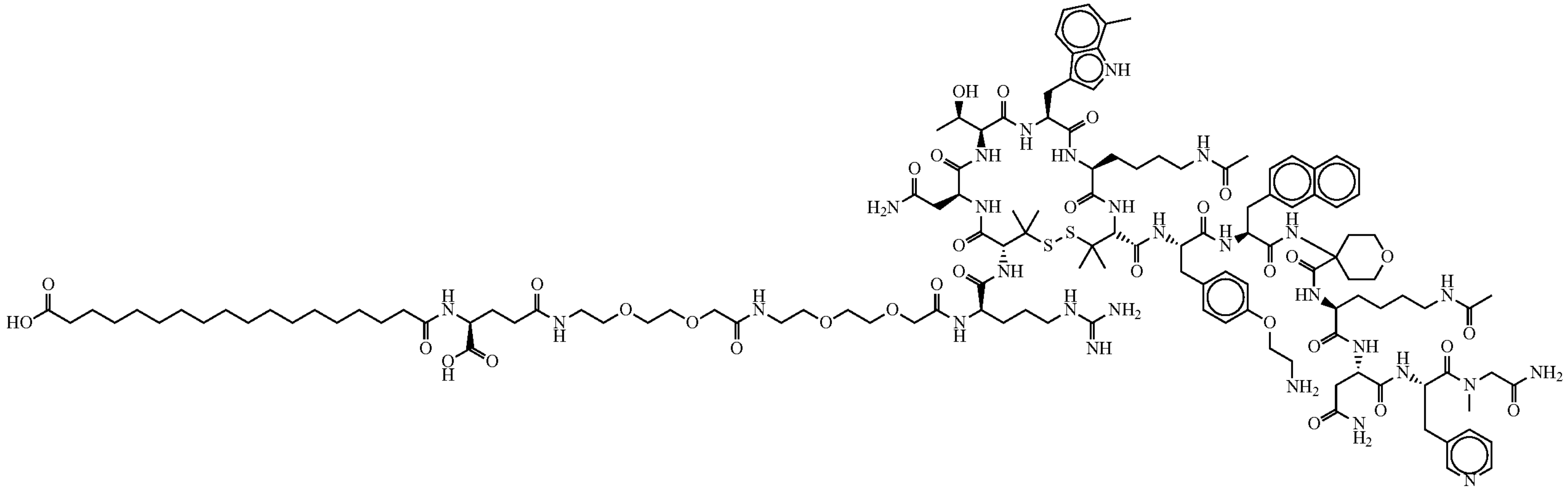 |

TABLE 1K-continued
| Compounds. | |
|---|---|
| SEQ ID. | Structure |
| 23 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Lys(1PEG2_1PEG2_IsoGlu_C16_Diacid)]-NH2 (Example 323) 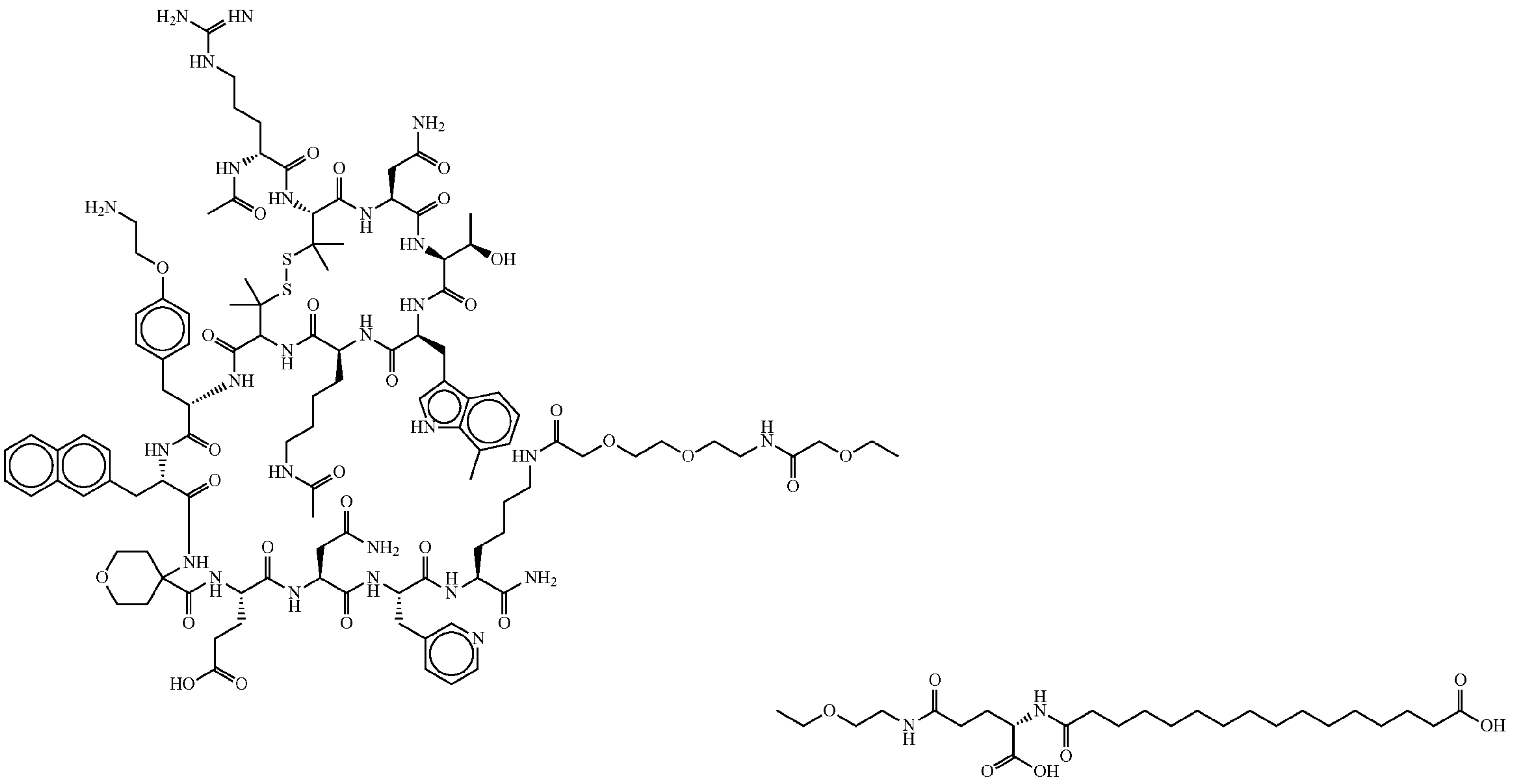 |

TABLE 1K-continued
| Compounds. | |
|---|---|
| SEQ ID. | Structure |
| 21 | Ac-[(D)Arg]-[Pen]-[Lys(1PEG2_1PEG2_IsoGlu_C16_Diacid)]-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 324) 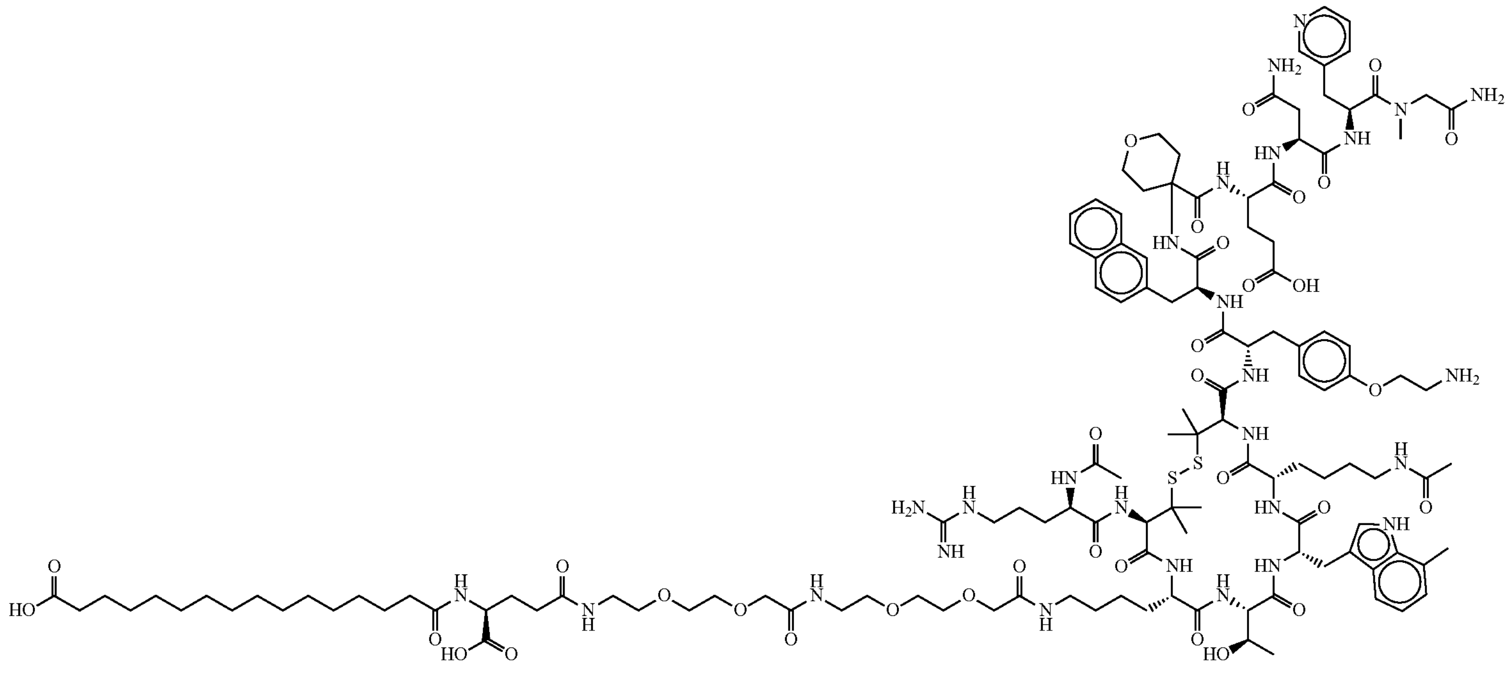 |

TABLE 1K-continued
| Compounds. | |
|---|---|
| SEQ ID. | Structure |
| 20 | Ac-[(D)Arg]-[Pen]-[Lys(1PEG2_1PEG2_IsoGlu_C18_Diacid)]-T-[Trp(7-Me)]-[Lys(Ac)]-[Pen]-[Phe(4-(2-aminoethoxy))]-[2Nal]-[THP]-E-N-[3Pal]-[Sarc]-NH2 (Example 325) 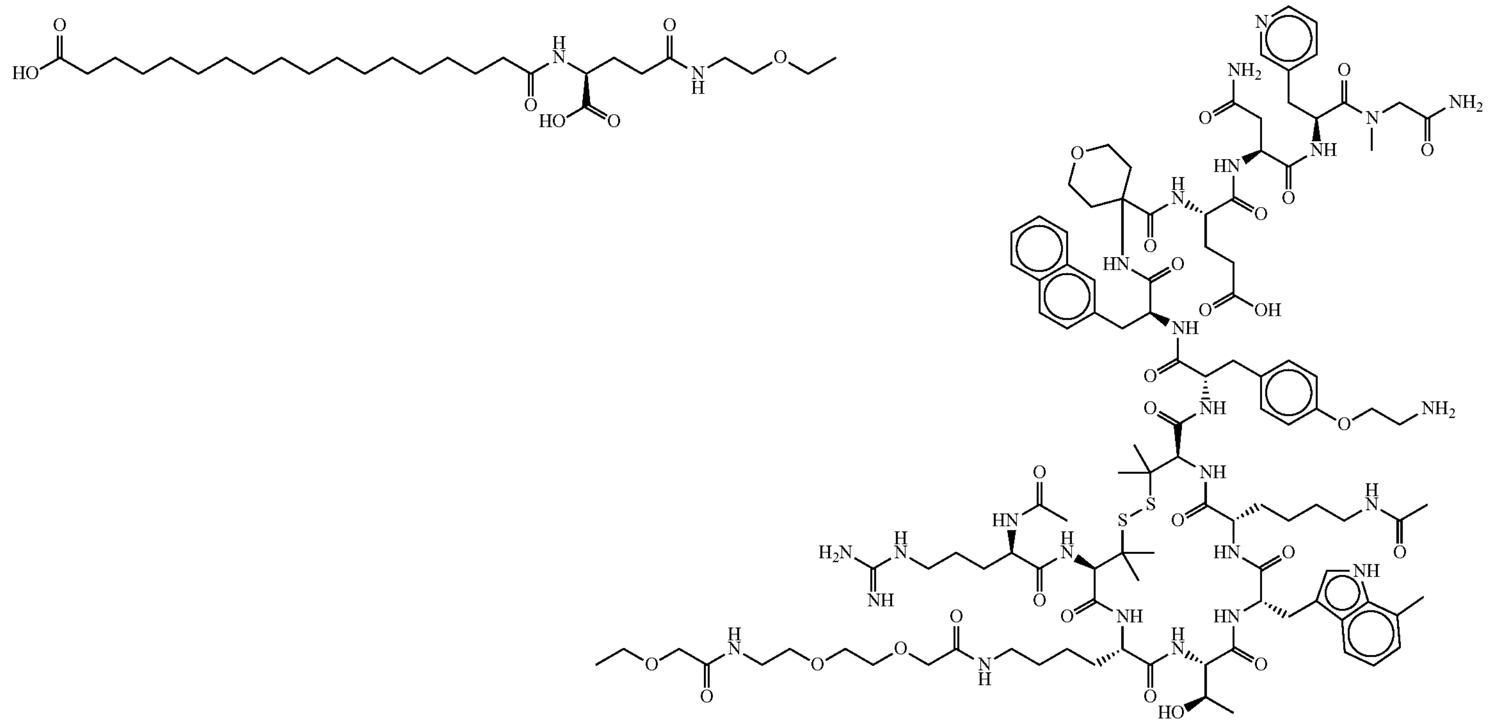 |

TABLE 1L
| Compounds. | |
|---|---|
| SEQ ID. | Structure |
| 19 | Ac-[Pen]-N-T-[Trp(7-Me)]-[Lys(Ac)]-[Pen]-[Phe(4-(2-aminoethoxy))]-[2Nal]-[THP]-[Lys(1PEG2_1PEG2_IsoGlu_C16_Diacid)]-N-[3Pal]-[Sarc]-NH2 (Example 326) 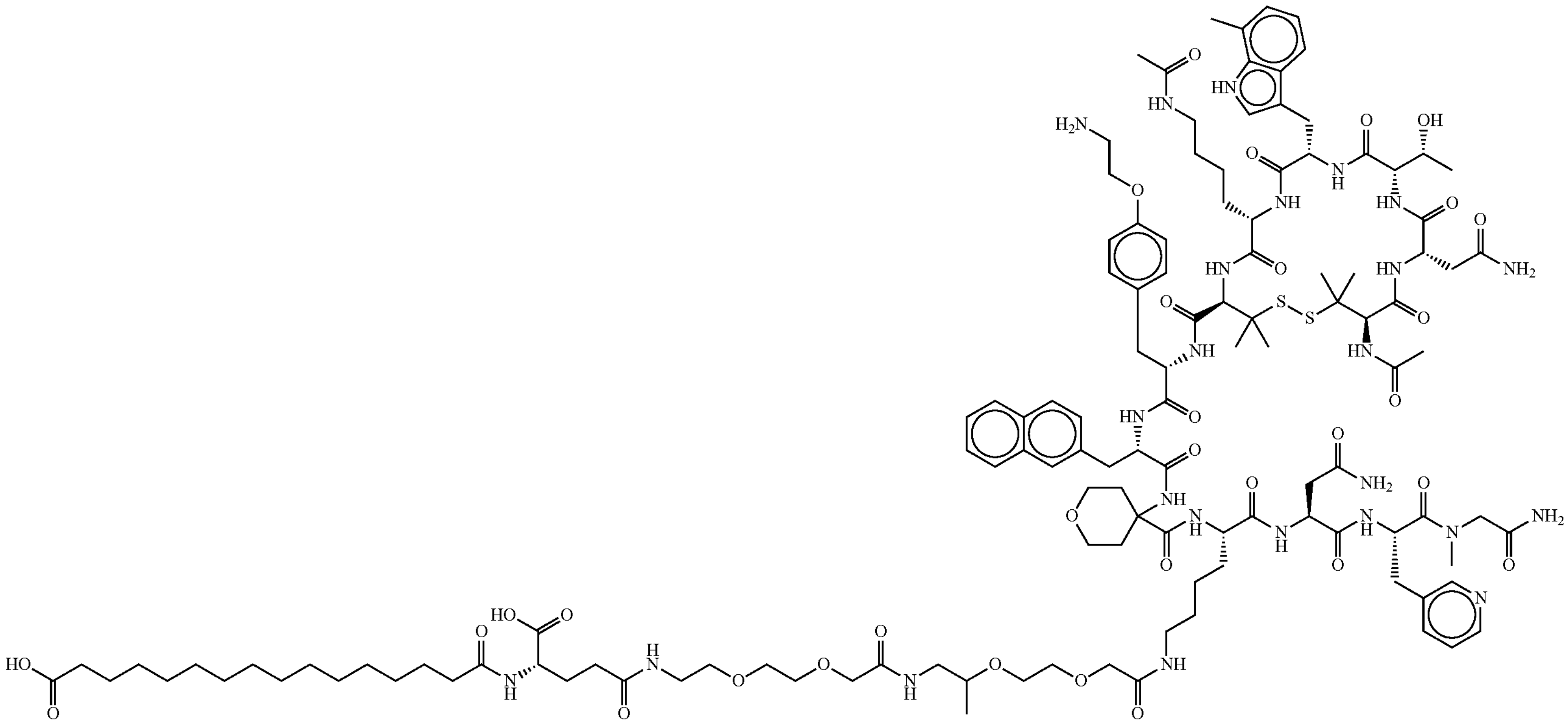 |

TABLE 1L-continued
| Compounds. | |
|---|---|
| SEQ ID. | Structure |
| 4 | Ac-[Pen]-N-T-[Trp(7-Me)]-[Lys(Ac)]-[Pen]-[Phe(4-(2-aminoethoxy))]-[2Nal]-[THP]-[Lys(1PEG2_1PEG2_IsoGlu_C18_Diacid)]-N-[3Pal]-[Sarc]-NH2 (Example 327) 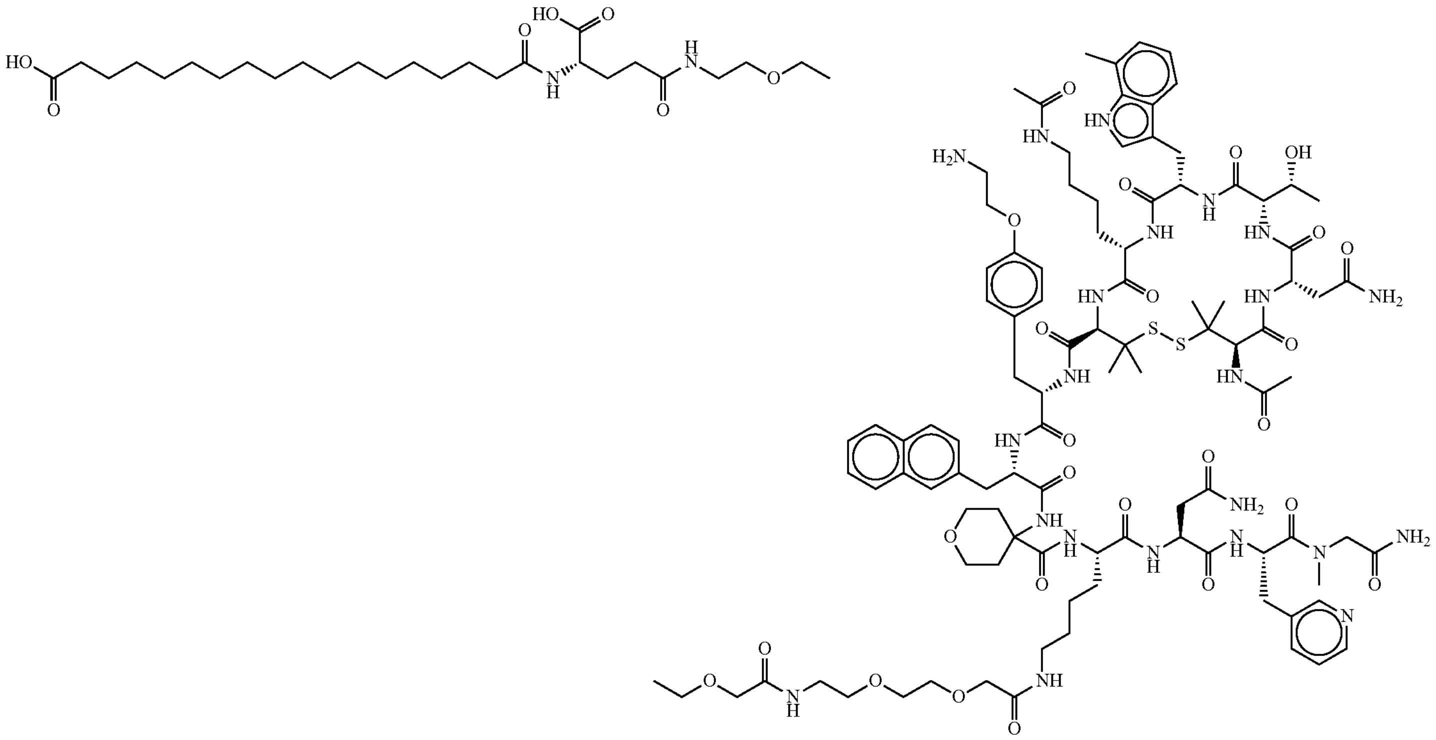 |

TABLE 1L-continued
| Compounds. | |
|---|---|
| SEQ ID. | Structure |
| 18 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Lys(1PEG2_1PEG2_IsoGlu_C18_Diacid)]-NH2 (Example 328) 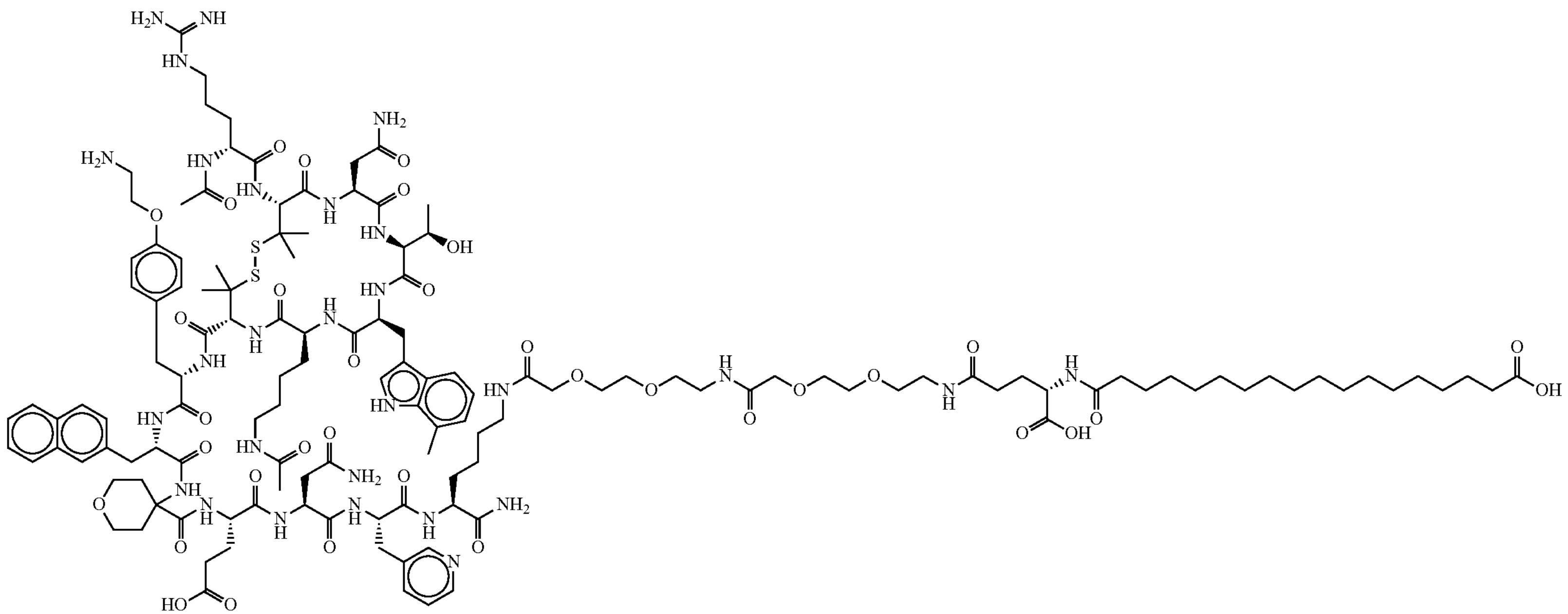 |

TABLE 1L-continued
| Compounds. | |
|---|---|
| SEQ ID. | Structure |
| 17 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[Lys(1PEG2_1PEG2_IsoGlu_C16_Diacid)]-NH2 (Example 329) 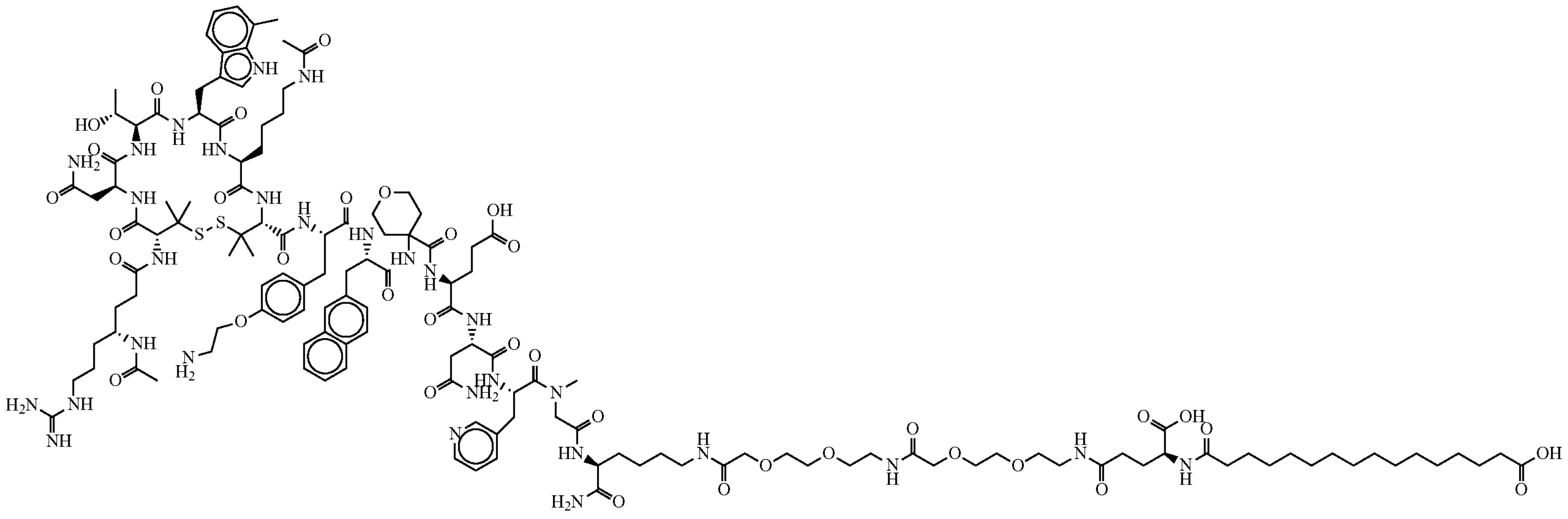 |

TABLE 1L-continued
| Compounds. | |
|---|---|
| SEQ ID. | Structure |
| 2 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[Lys(1PEG2_1PEG2_IsoGlu_C18_Diacid)]-NH2 (Example 330) 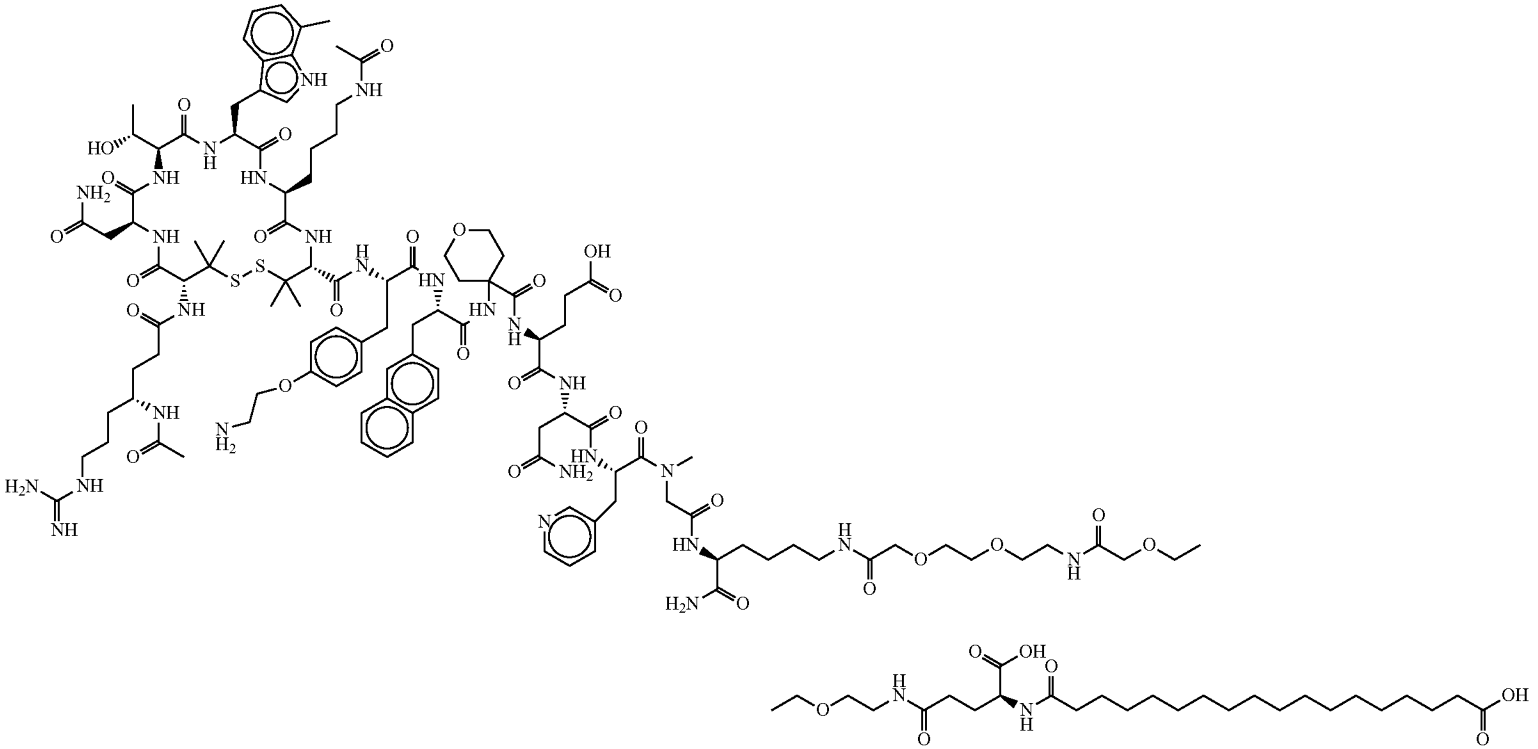 |

TABLE 1L-continued
| Compounds. | |
|---|---|
| SEQ ID. | Structure |
| 263 | [1PEG2_1PEG2_IsoGlu_C18]-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-NH2 (Example 331) 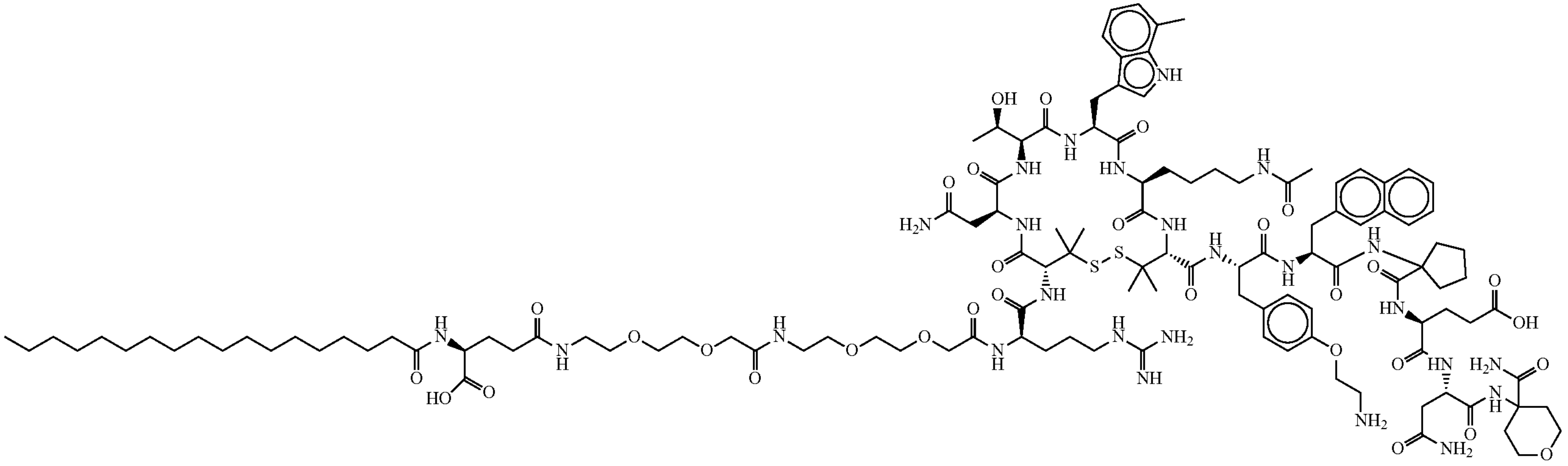 |

TABLE 1L-continued
| Compounds. | |
|---|---|
| SEQ ID. | Structure |
| 264 | [1PEG2_1PEG2_IsoGlu_C18_Diacid]-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-NH2<br>(Example 332)<br>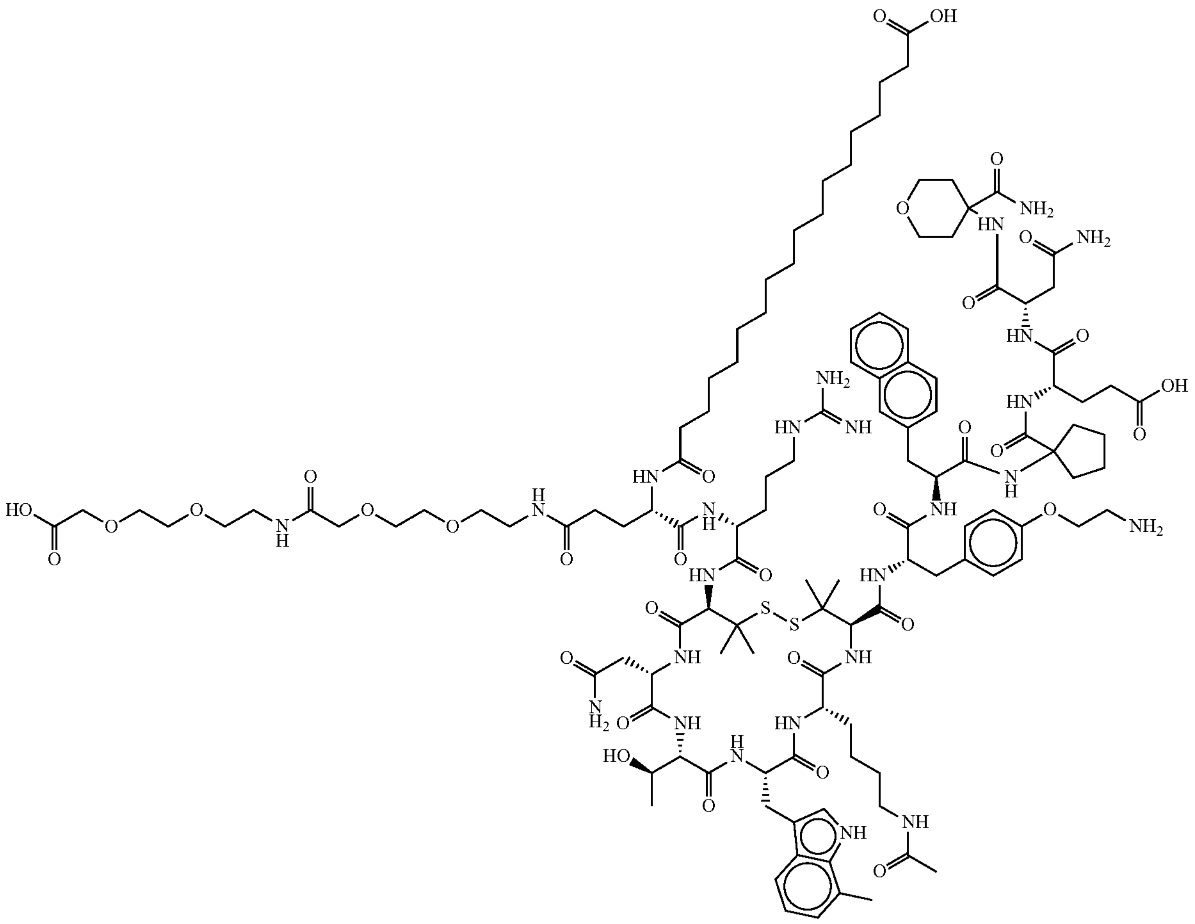 |

TABLE 1L-continued
| Compounds. | |
|---|---|
| SEQ ID. | Structure |
| 265 | Ac-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-[Lys(1PEG2_1PEG2_IsoGlu_C18_Diacid)]-NH2 (Example 333) 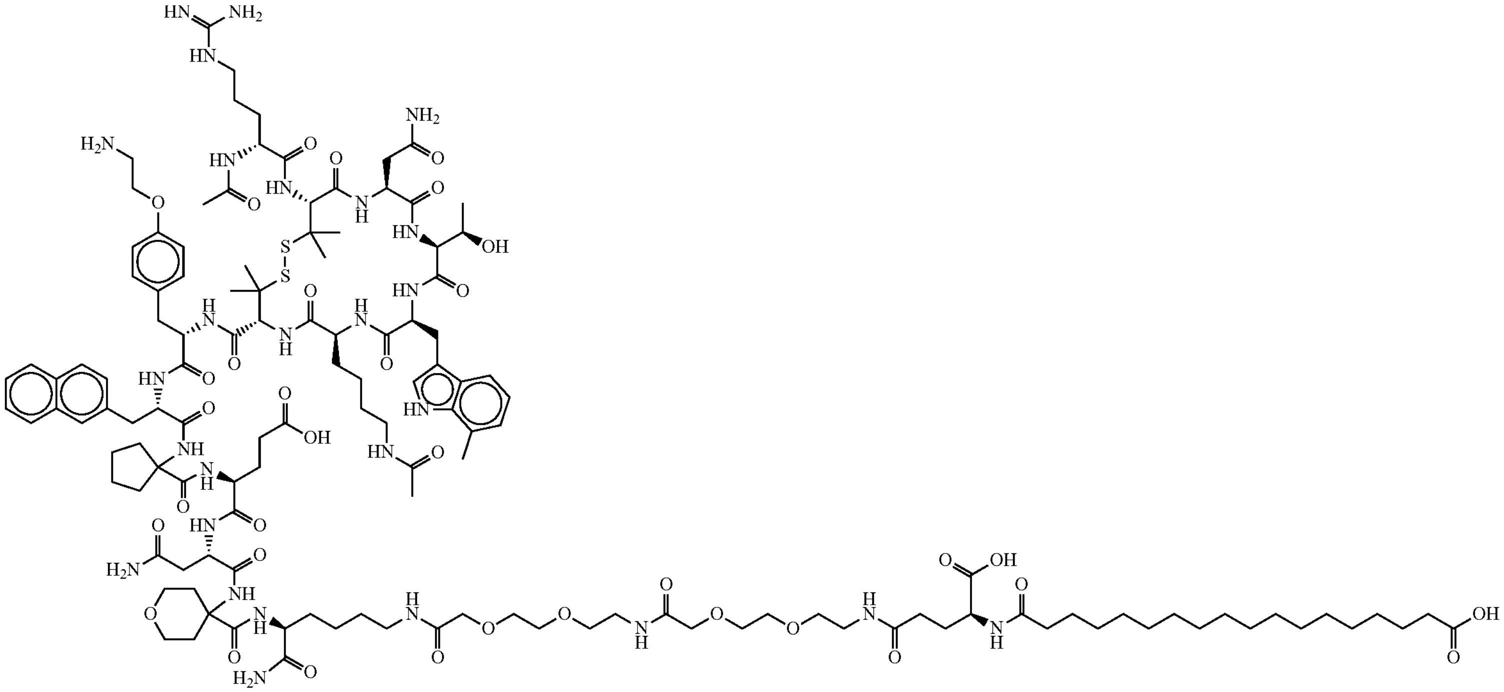 |

TABLE 1L-continued
| Compounds. | |
| --- | --- |
| SEQ ID. | Structure |
| 266 | Ac-[(D)Lys(1PEG2_1PEG2_IsoGlu_C18_Diacid)]-[Pen]-N-T-[Trp(7-Me)]-[Lys(Ac)]-[Pen]-[Phe(4-(2-aminoethoxy))]-[2Nal]-[Acvc]-E-N-[THP]-NH2 (Example 334) 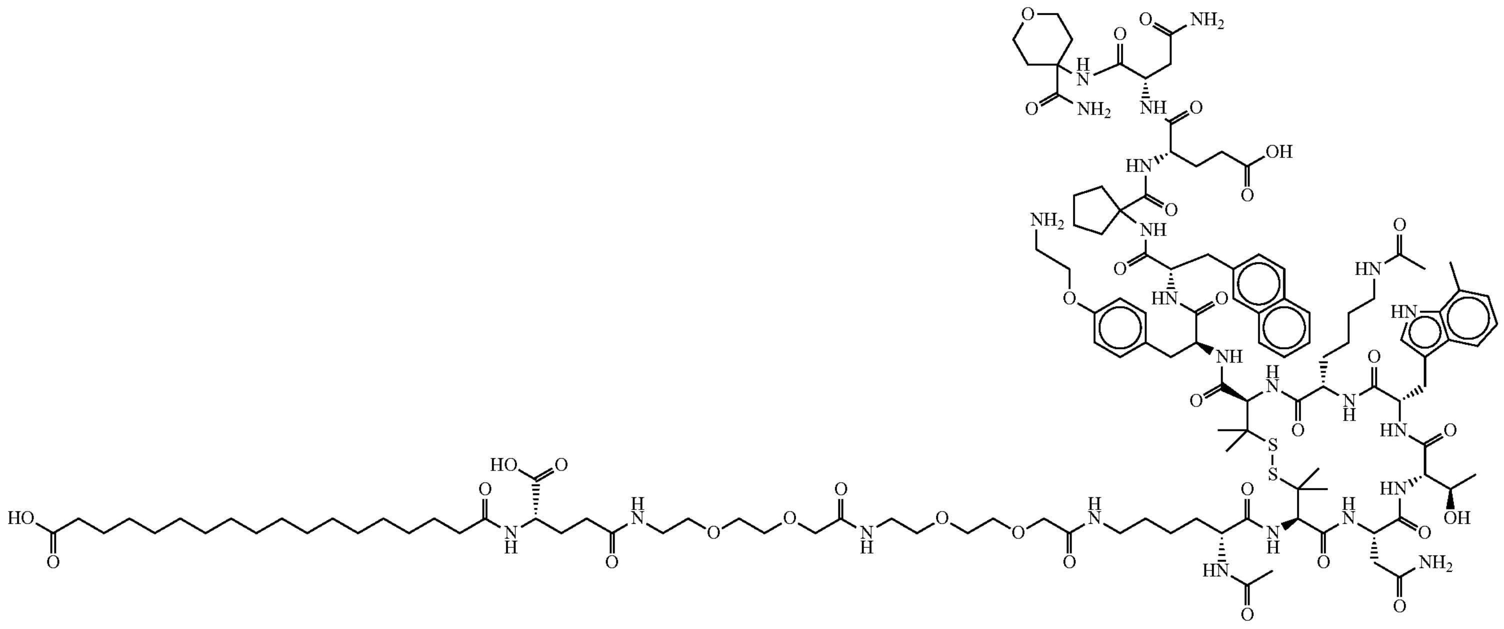 |

TABLE 1L-continued
| Compounds. | |
|---|---|
| SEQ ID. | Structure |
| 267 | Ac-[(D)Lys(1PEG2_1PEG2_IsoGlu_C16_Diacid)]-[Pen]-N-T-[Trp(7-Me)]-[Lys(Ac)]-[Pen]-[Phe(4-(2-aminoethoxy))]-[2Nal]-[Acvc]-E-N-[THP]-NH2 (Example 335) 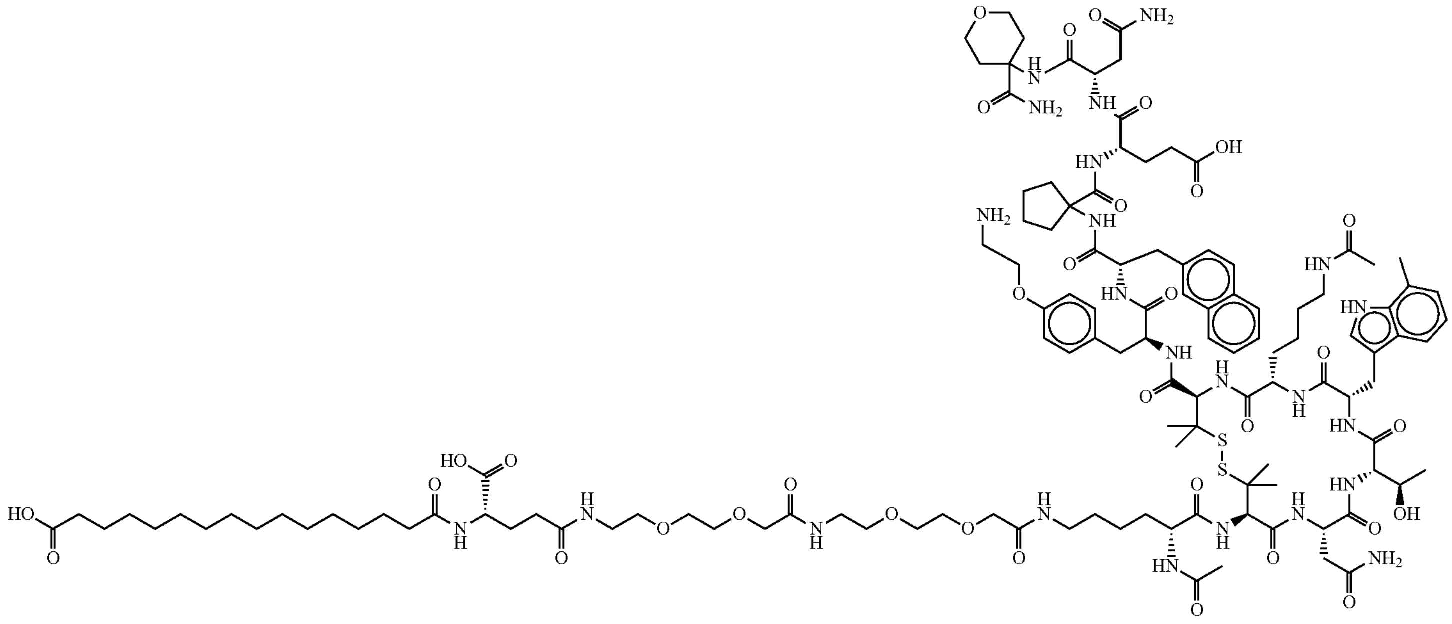 |

TABLE 1L-continued
| Compounds. | |
|---|---|
| SEQ ID. | Structure |
| 268 | Ac-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-[Lys(1PEG2_1PEG2_IsoGlu_C18)]-NH2 (Example 336) 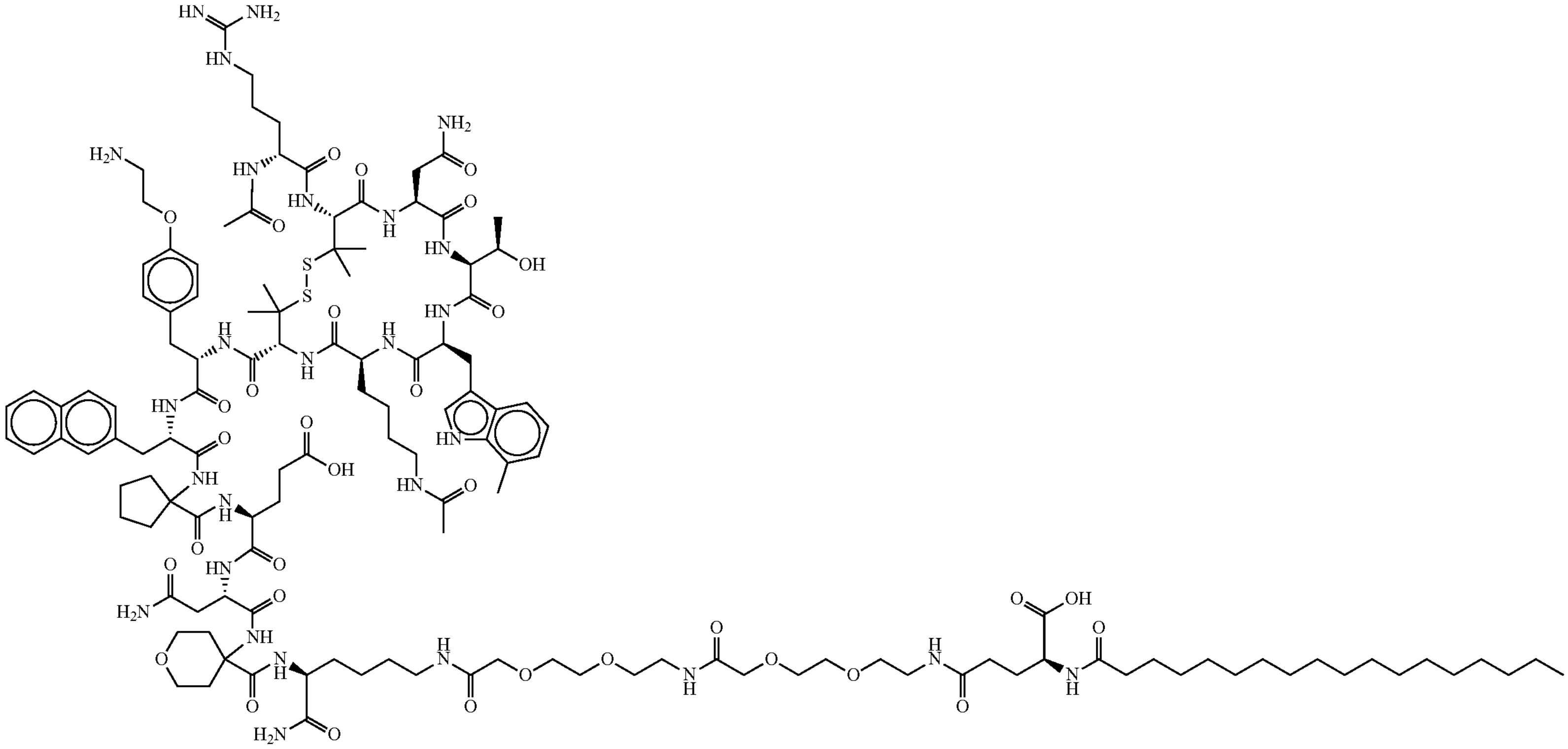 |

TABLE 1L-continued
| Compounds. | |
|---|---|
| SEQ ID. | Structure |
| 269 | Ac-[Pen]-N-T-[Trp(7-Me)]-[Lys(Ac)]-[Pen]-[Phe(4-(2-aminoethoxy))]-[3Quin]-[THP]-E-N-H-[Sarc]-NH2-[PEG4] (Example 337) 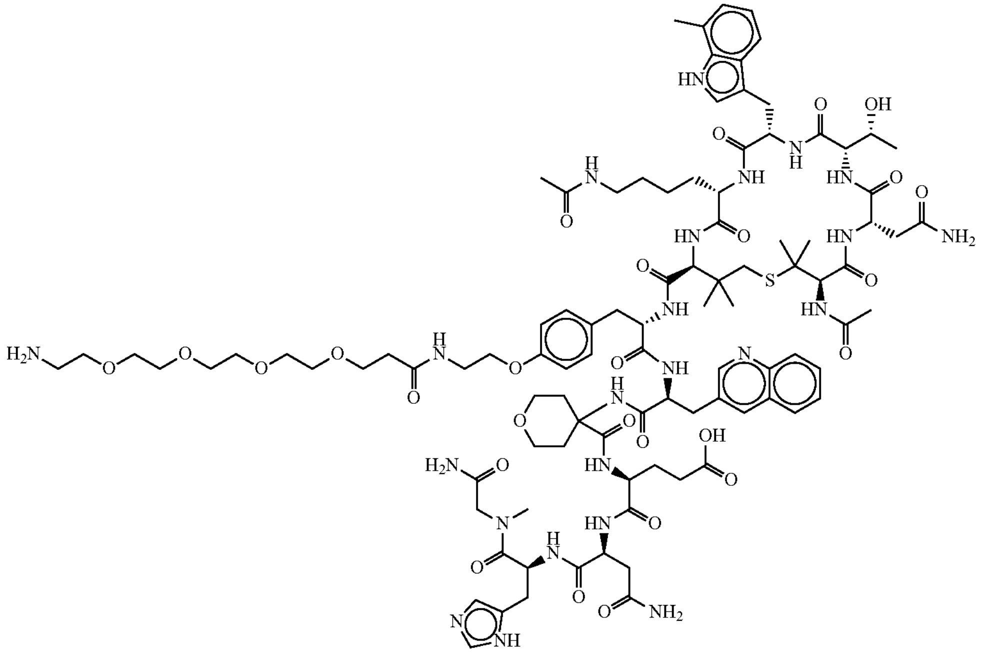 |

TABLE 1L-continued
| Compounds. | |
|---|---|
| SEQ ID. | Structure |
| 270 | Ac-[Pen]-N-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-N-[3Pal]-[Sarc]-NH2 (Example 338) 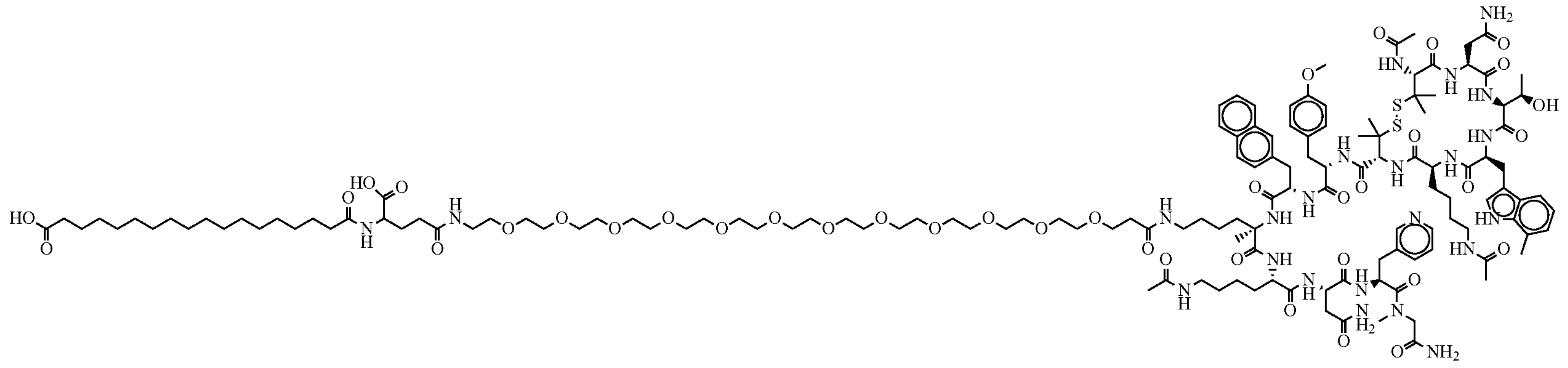 |

TABLE 1L-continued
| Compounds. | |
|---|---|
| SEQ ID. | Structure |
| 271 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-[Lys(Ac)]-N-[3Pal]-[Sarc]-NH2 (Example 339) 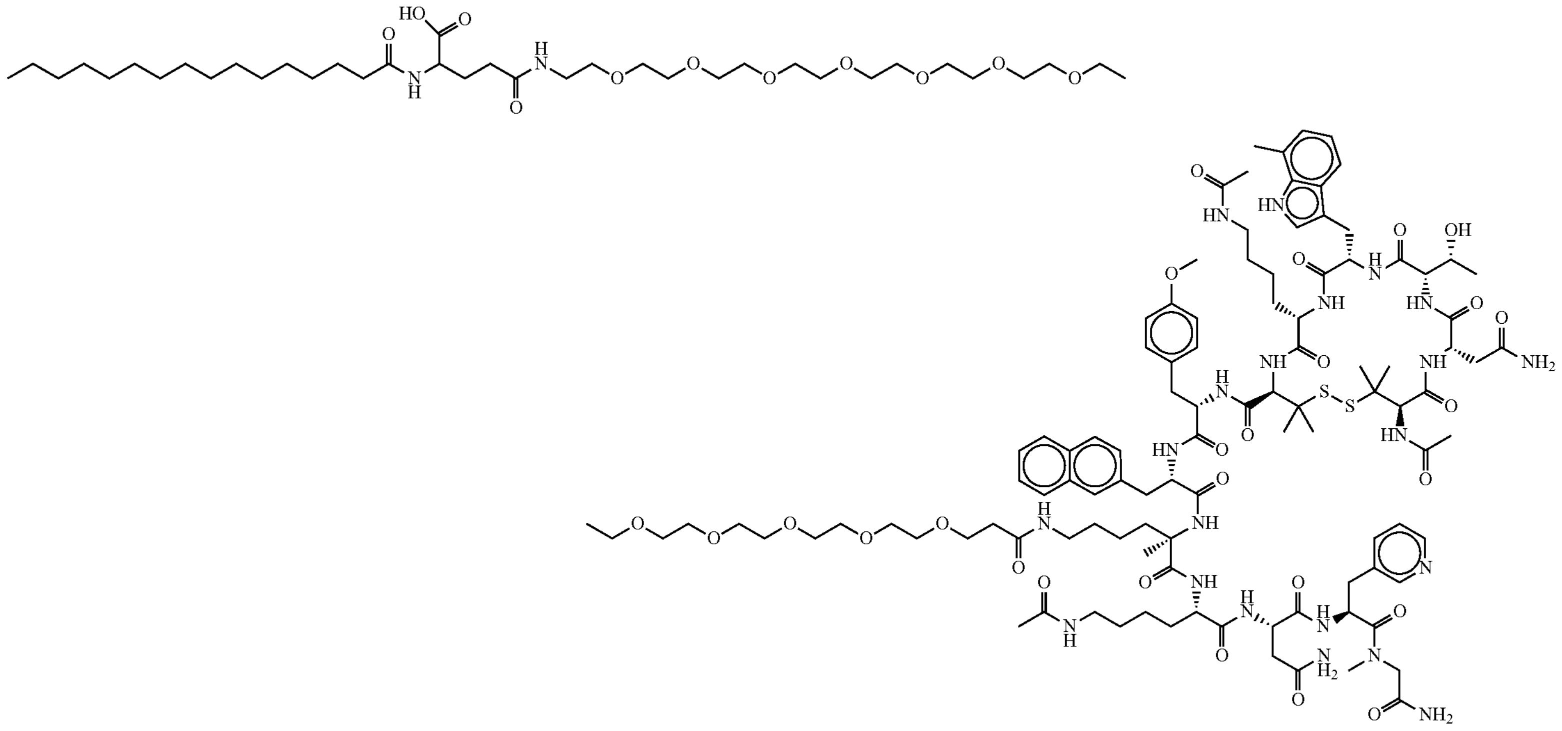 |

TABLE 1L-continued
| Compounds. | |
|---|---|
| SEQ ID. | Structure |
| 272 | [PEG12_OMe]-[Pen]-L-T-[Trp(7-Me)]-[Lys(Ac)]-[Pen]-F-[Nal]-[aMeLeu]-L-N-[NH(2-(pyridin-3-yl)ethyl)] (Example 340)<br>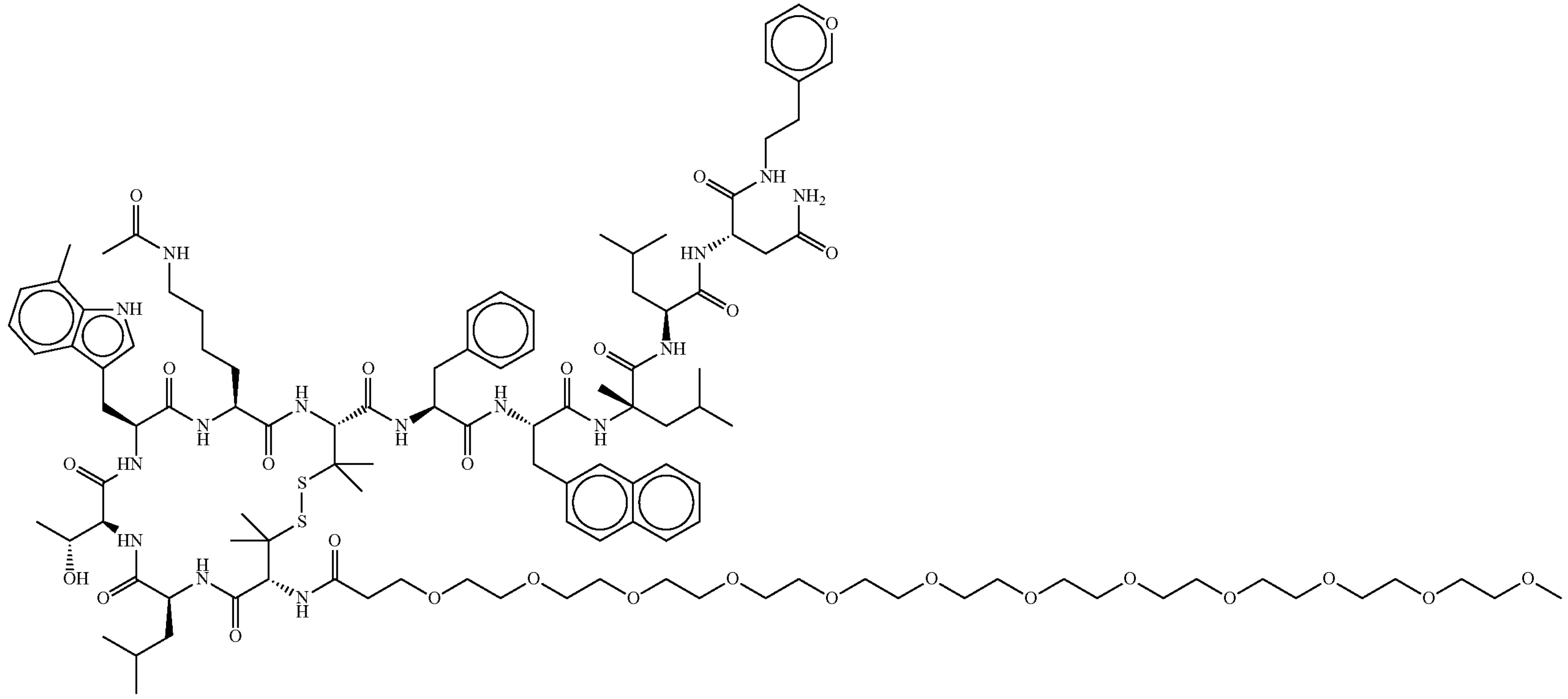 |

TABLE 1L-continued
| Compounds. | |
|---|---|
| SEQ ID. | Structure |
| 273 | Ac-[Pen]-L-T-[Trp(7-Me)]-[Lys(PEG12_OMe)]-[Pen]-F-[Nal]-[aMeLeu]-L-N-[NH(2-(pyridin-3-yl)ethyl)] (Example 341)<br>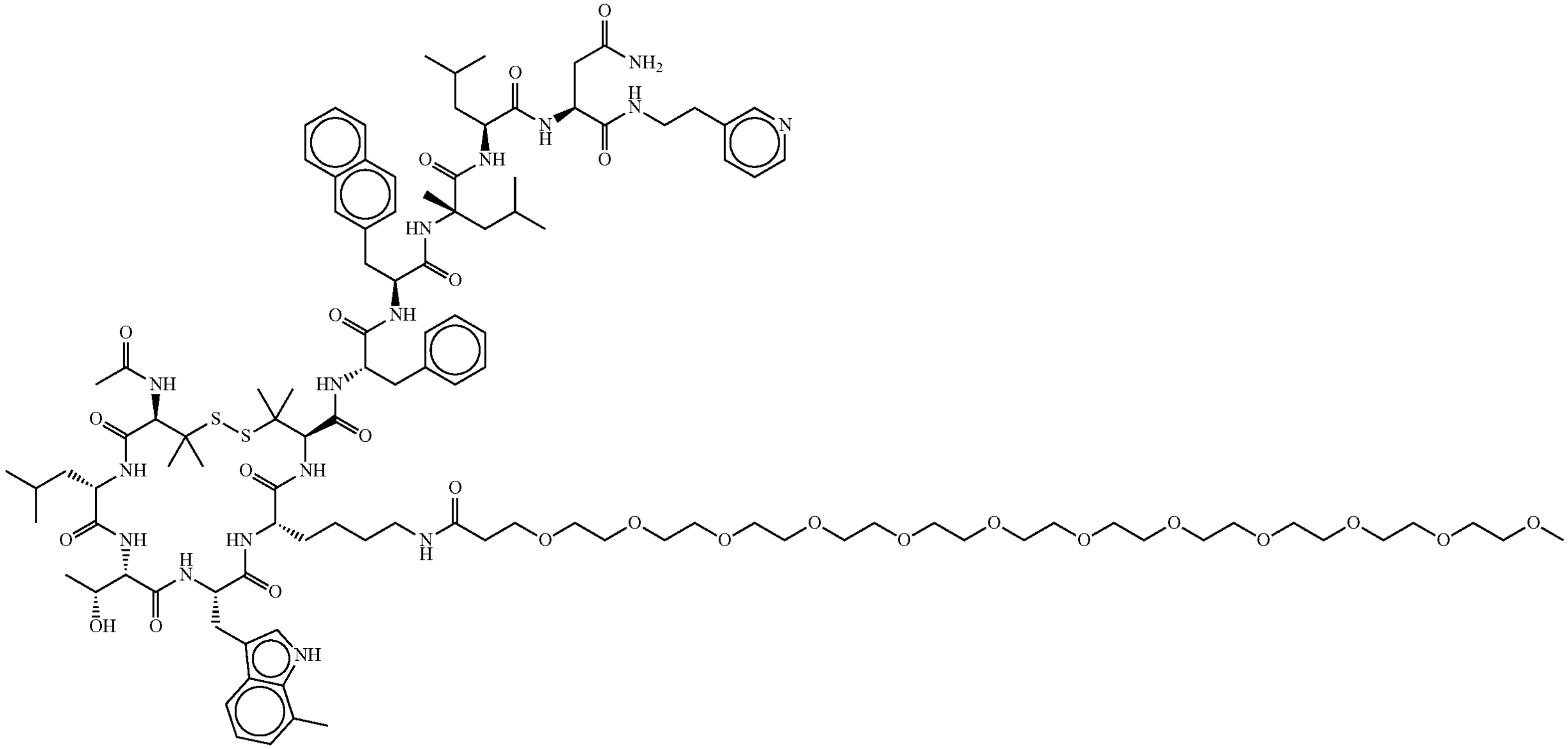 |

TABLE 1L-continued
| Compounds. | |
|---|---|
| SEQ ID. | Structure |
| 274 | [PEG12_OMe]-[Pen]-L-T-[Trp(7-Me)]-[Lys(Ac)]-[Pen]-[Phe(4-OMe)]-[Nal]-[aMeLeu]-L-N-[NH(2-(pyridin-3-yl)ethyl)] (Example 342)<br>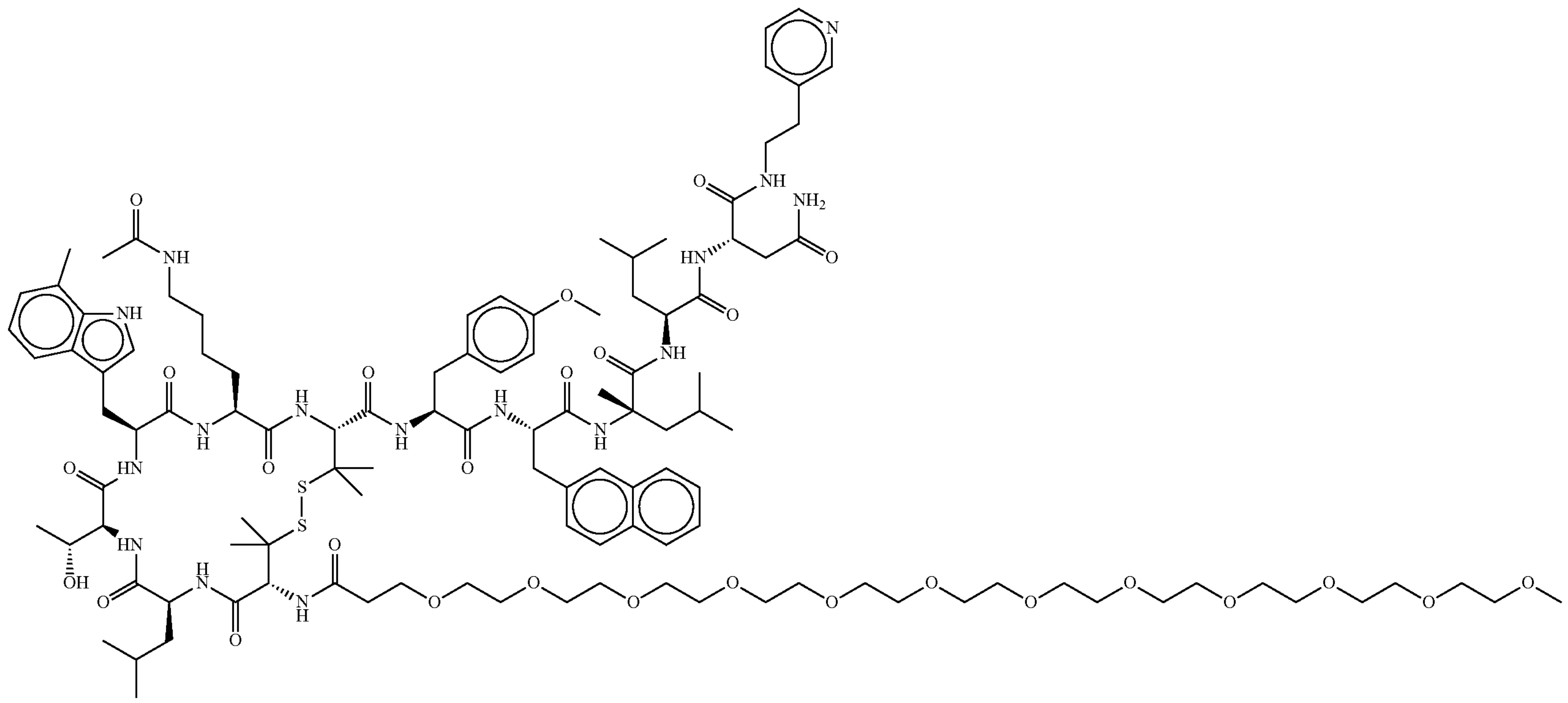 |

TABLE 1L-continued
| Compounds. | |
|---|---|
| SEQ ID. | Structure |
| 275 | Ac-[Pen]-L-T-[Trp(7-Me)]-[Lys(PEG12_OMe)]-[Pen]-[Phe(4-OMe)]-[Nal]-[aMeLeu]-L-N-[NH(2-(pyridin-3-yl)ethyl)] (Example 343)<br>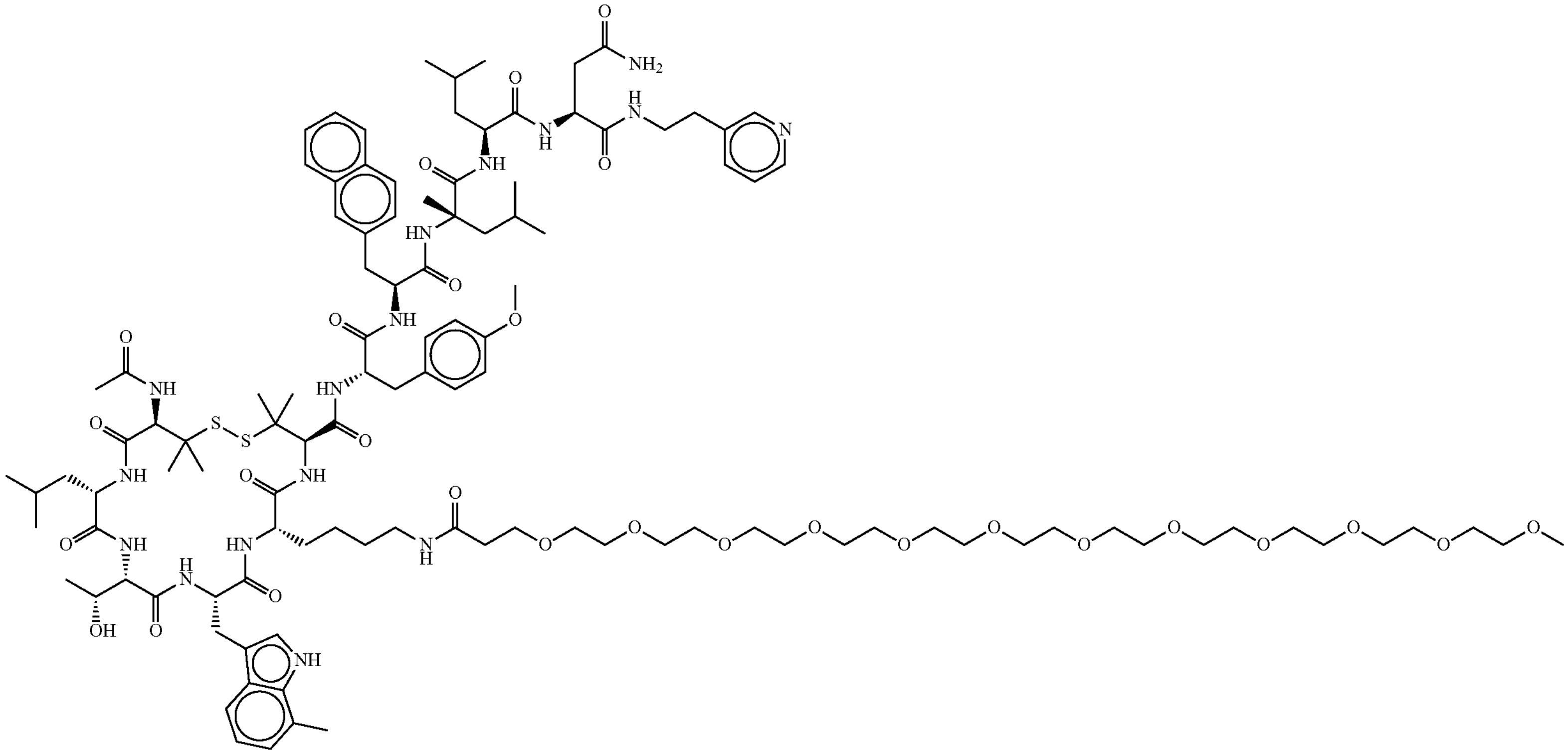 |

TABLE 1L-continued
| Compounds. | |
|---|---|
| SEQ ID. | Structure |
| 276 | [PEG12_OMe]-[Pen]-[aMeAsn]-T-[Trp(7-Me)]-[Lys(Ac)]-[Pen]-F-[Nal]-[aMeLeu]-L-N-[NH(2-(pyridin-3-yl)ethyl)] (Example 344)<br>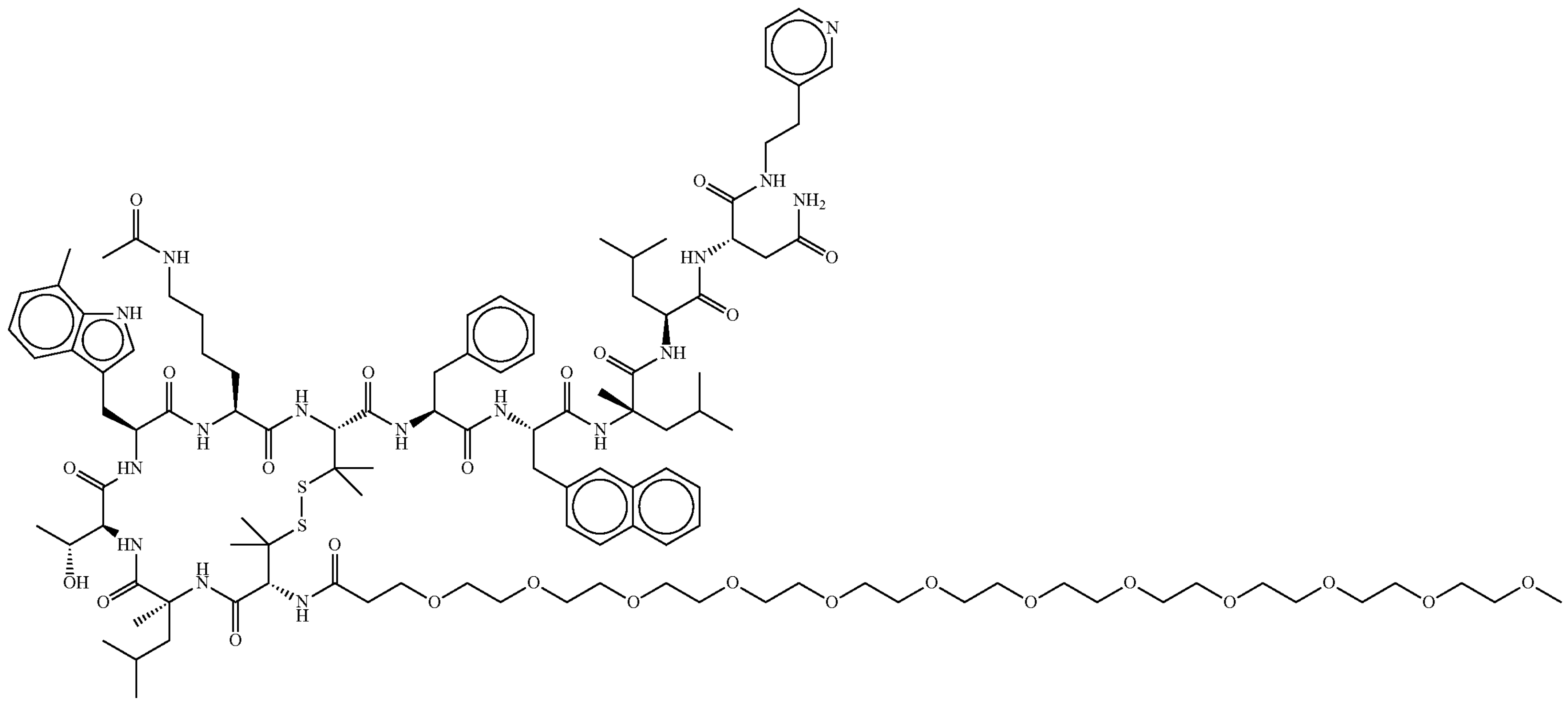 |

TABLE 1L-continued
| Compounds. | |
|---|---|
| SEQ ID. | Structure |
| 277 | Ac-[Pen]-[aMeAsn]-T-[Trp(7-Me)]-[Lys(PEG12_OMe)]-[Pen]-F-[Nal]-[aMeLeu]-L-N-[NH(2-(pyridin-3-yl)ethyl)] (Example 345) 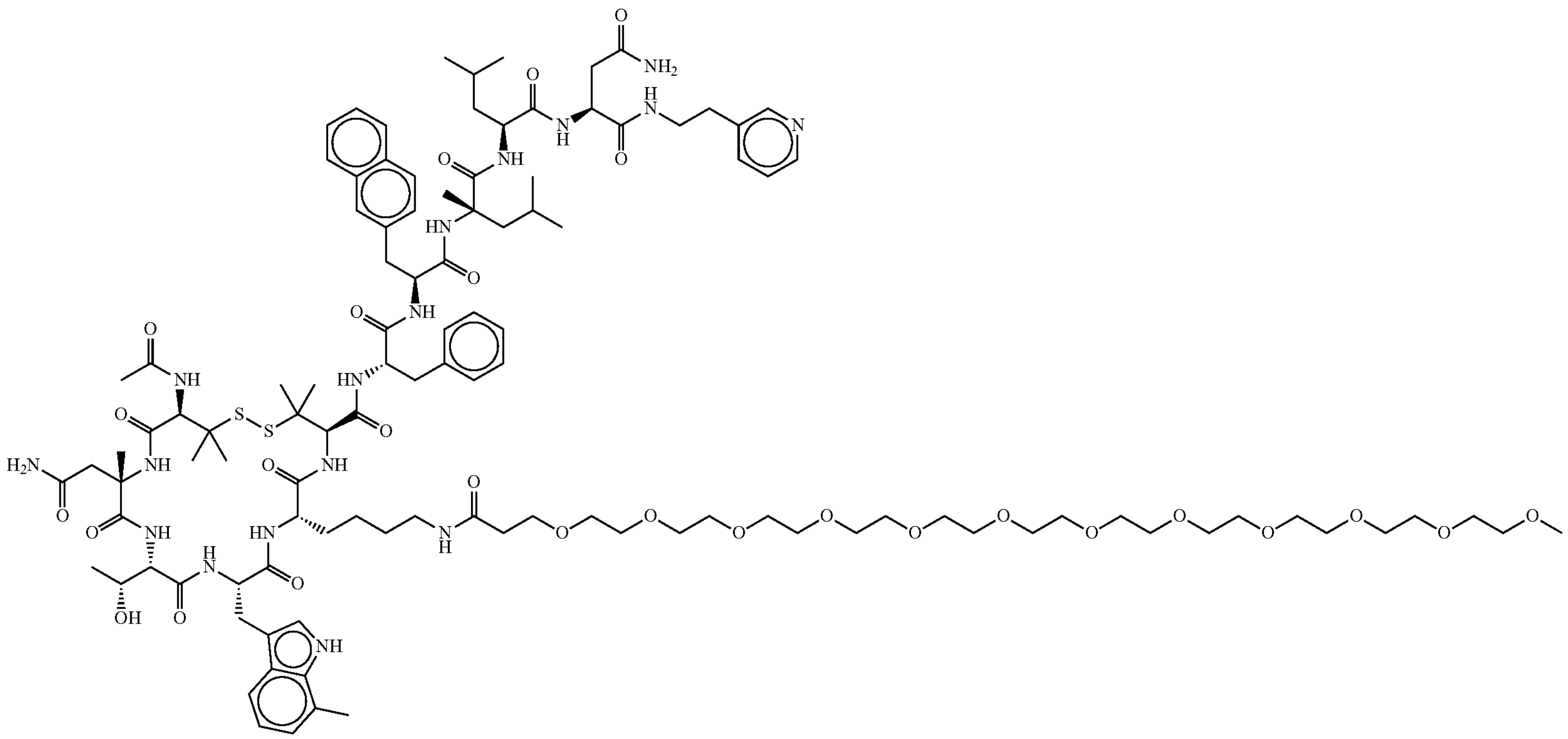 |

TABLE 1L-continued
| Compounds. | |
|---|---|
| SEQ ID. | Structure |
| 278 | [PEG12_OMe]-[Pen]-[aMeAsn]-T-[Trp(7-Me)]-[Lys(Ac)]-[Pen]-[Phe(4-OMe)]-[Nal]-[aMeLeu]-L-N-[NH(2-(pyridin-3-yl)ethyl)] (Example 346) 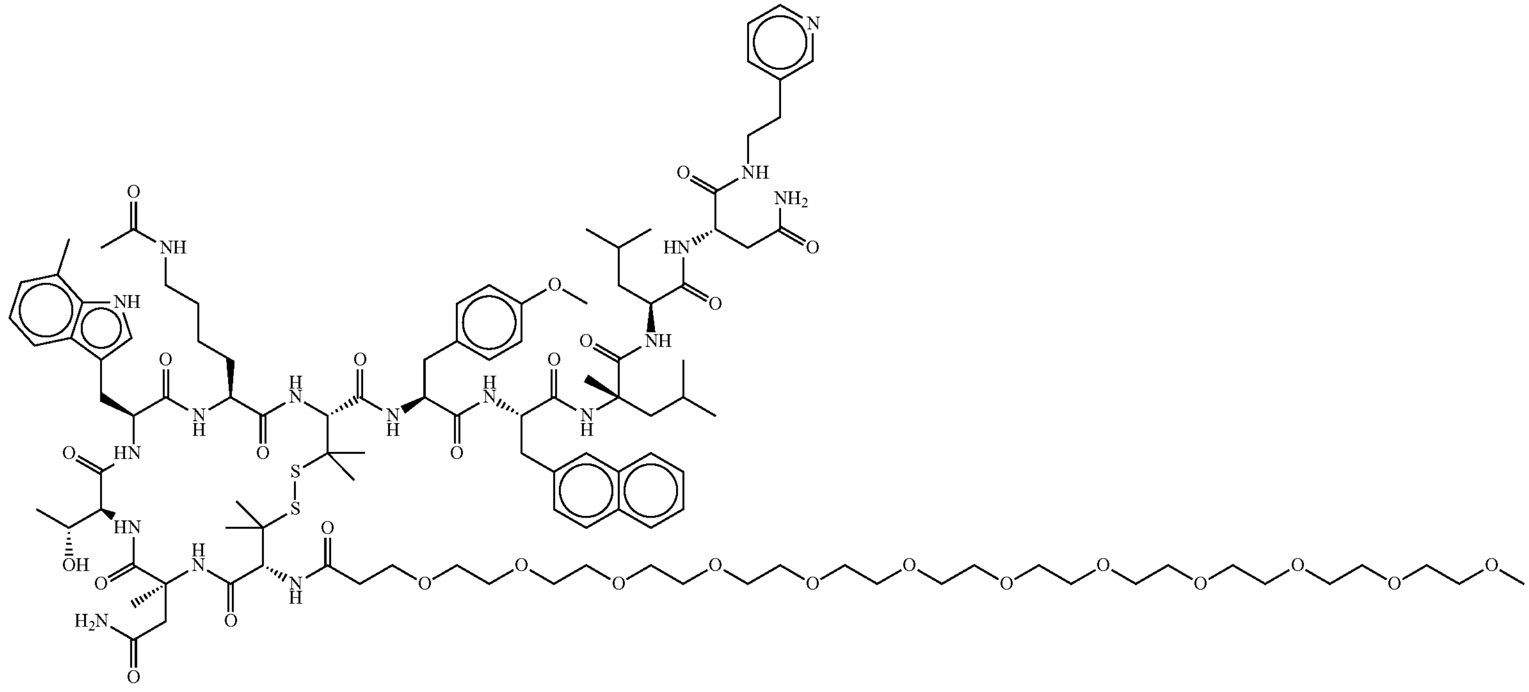 |

TABLE 1L-continued
| Compounds. | |
|---|---|
| SEQ ID. | Structure |
| 279 | Ac-[Pen]-[aMeAsn]-T-[Trp(7-Me)]-[Lys(PEG12_OMe)]-[Pen]-[Phe(4-OMe)]-[Nal]-[aMeLeu]-L-N-[NH(2-(pyridin-3-yl)ethyl)] (Example 347) 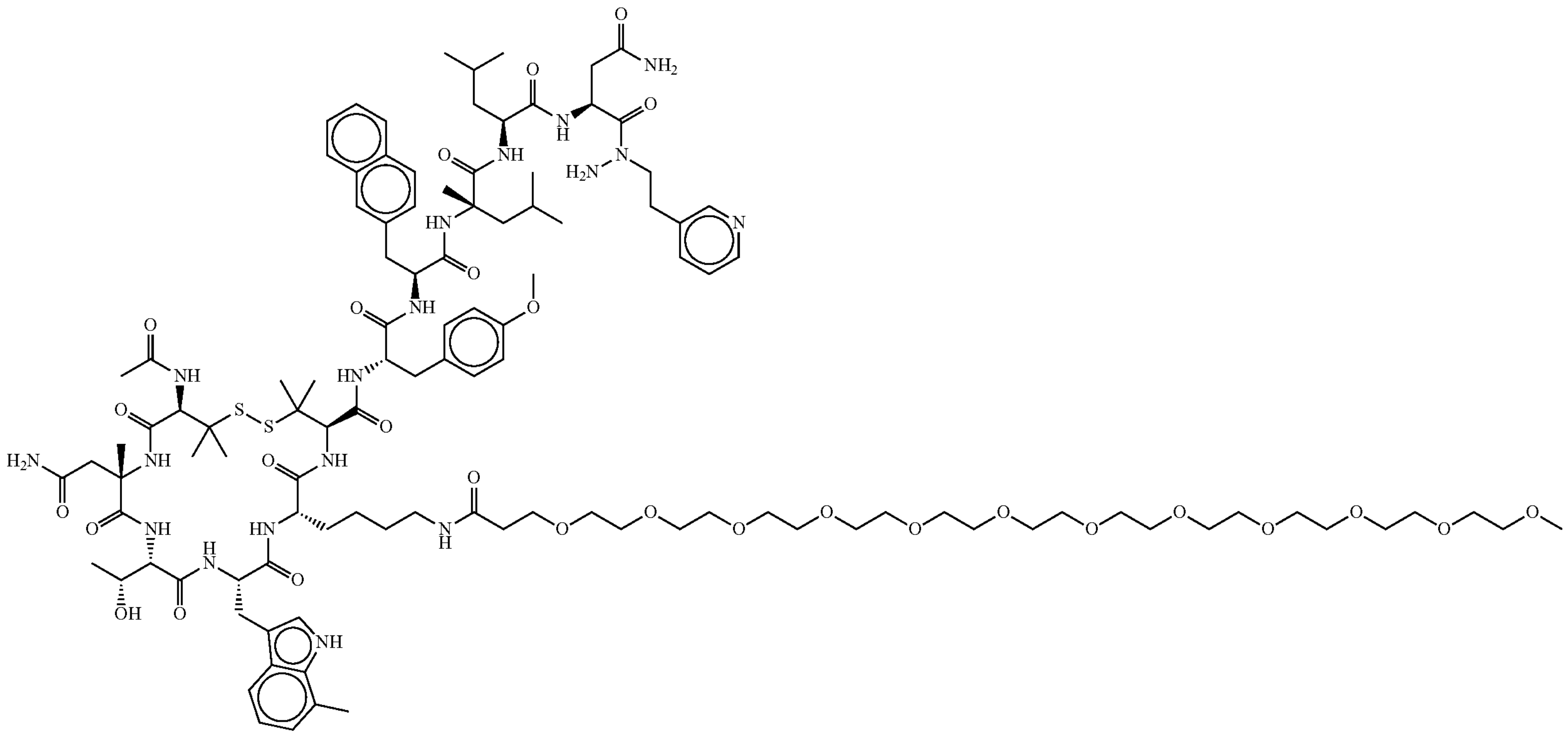 |

TABLE 1M
| Compounds. | |
|---|---|
| SEQ ID | Structure<br>Peptide Sequence<br>Smiles |
| 280 | 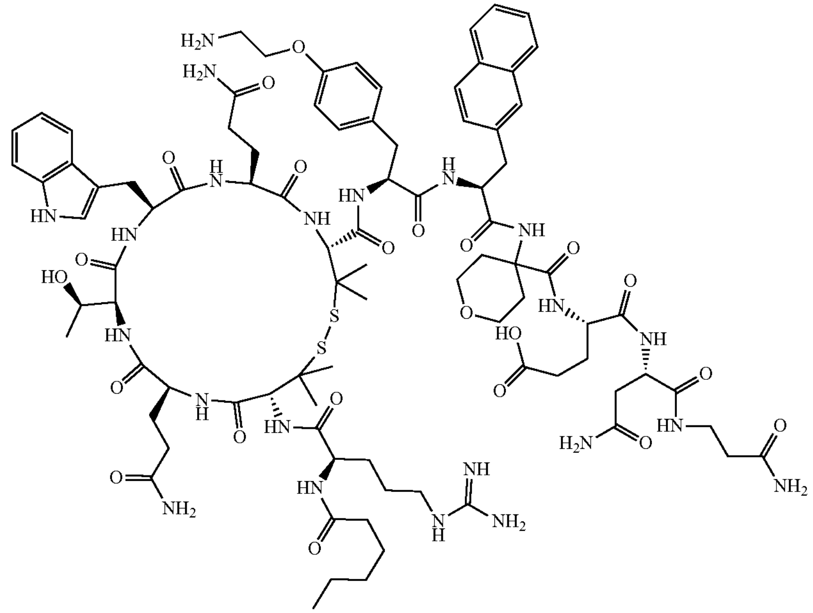 [SMILES: CCCCCC(=O)N[C@H](CCCNC(=N)N)C(=O)N[C@@H]1C(=O)N[C@@H](CCC(N)=O)C(=O)N[C@@H]([C@@H](C)O)C(=O)N[C@@H](Cc2c[nH]c3ccccc23)C(=O)N[C@@H](CCC(N)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)NCCC(N)=O)CCOCC2)C(C)(C)SSC1(C)C]<br>PentCO-r-Pen(3)-Q-T-W-Q-Pen(3)-AEF-2Nal-THP-E-N-bAla-CONH2<br>CCCCCC(N[C@H](CCCNC(N)=N)C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(NCCC(N)=O)=O)=O)=O)=O)=O)=O)NC([C@H](CCC(N)=O)NC([C@H](Cc1c[nH]c2c1cccc2)NC([C@H]([C@@H](C)O)NC([C@H](CCC(N)=O)N1)=O)=O)=O)=O)C1=O)=O)=O |

TABLE 1M-continued

| Compounds. | |
|---|---|
| SEQ ID | Structure<br>Peptide Sequence<br>Smiles |
| 281 | 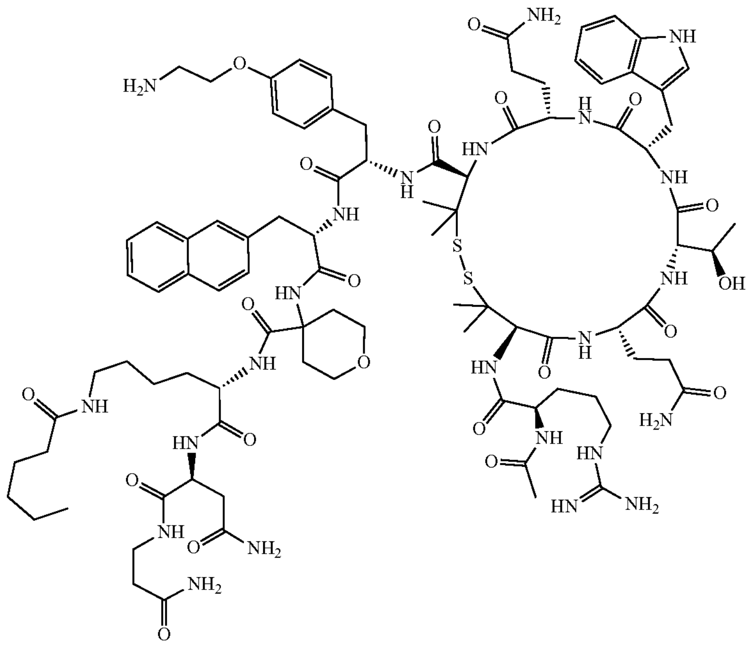 [SMILES: CCCCCC(=O)NCCCC[C@H](NC(=O)C1(NC(=O)[C@H](Cc2ccc3ccccc3c2)NC(=O)[C@H](Cc2ccc(OCCN)cc2)NC(=O)[C@H]2NC(=O)[C@H](CCC(N)=O)NC(=O)[C@H](Cc3c[nH]c4ccccc34)NC(=O)[C@H]([C@@H](C)O)NC(=O)[C@H](CCC(N)=O)NC(=O)[C@@H](NC(=O)[C@@H](CCCNC(=N)N)NC(C)=O)C(C)(C)SSC2(C)C)CCOCC1)C(=O)N[C@@H](CC(N)=O)C(=O)NCCC(N)=O]<br>MeCO-r-Pen(3)-Q-T-W-Q-Pen(3)-AEF-2Nal-THP-K(COPent)-N-bAla-CONH2<br>CCCCCC(NCCCC[C@@H](C(N[C@@H](CC(N)=O)C(NCCC(N)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CCC(N)=O)C(N[C@@H]([C@@H](C)O)C(N[C@@H](Cc1c[nH]c2c1cccc2)C(N[C@H]1CCC(N)=O)=O)=O)=O)=O)NC([C@@H](CCCNC(N)=N)NC(C)=O)=O)NC1=O)=O)=O)=O)=O)=O |

TABLE 1M-continued
| Compounds. | |
|---|---|
| SEQ ID | Structure<br>Peptide Sequence<br>Smiles |
| 282 | 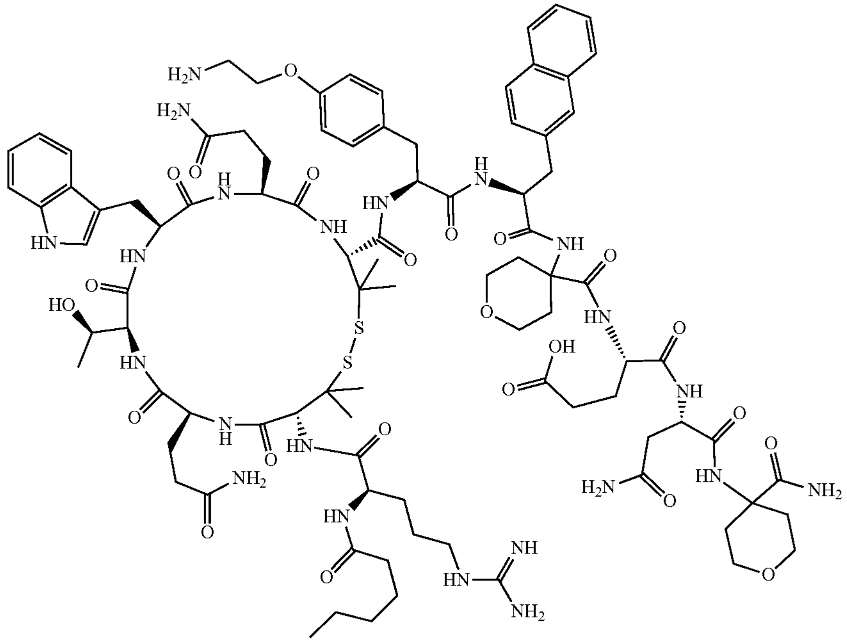 [SMILES: CCCCCC(=O)N[C@H](CCCNC(=N)N)C(=O)N[C@@H]1C(=O)N[C@@H](CCC(N)=O)C(=O)N[C@@H]([C@@H](C)O)C(=O)N[C@@H](Cc2c[nH]c3ccccc23)C(=O)N[C@@H](CCC(N)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)NC3(C(N)=O)CCOCC3)CCOCC2)C(C)(C)SSC1(C)C]<br>PentCO-r-Pen(3)-Q-T-W-Q-Pen(3)-AEF-2Nal-THP-E-N-THP-CONH2<br>CCCCCC(N[C@H](CCCNC(N)=N)C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(NC1(CCOCC1)C(N)=O)=O)=O)=O)=O)=O)=O)NC([C@H](CCC(N)=O)NC([C@H](Cc1c[nH]c2c1cccc2)NC([C@H]([C@@H](C)O)NC([C@H](CCC(N)=O)N1)=O)=O)=O)=O)C1=O)=O)=O |

TABLE 1M-continued

| Compounds. | |
|---|---|
| SEQ ID | Structure<br>Peptide Sequence<br>Smiles |
| 283 | 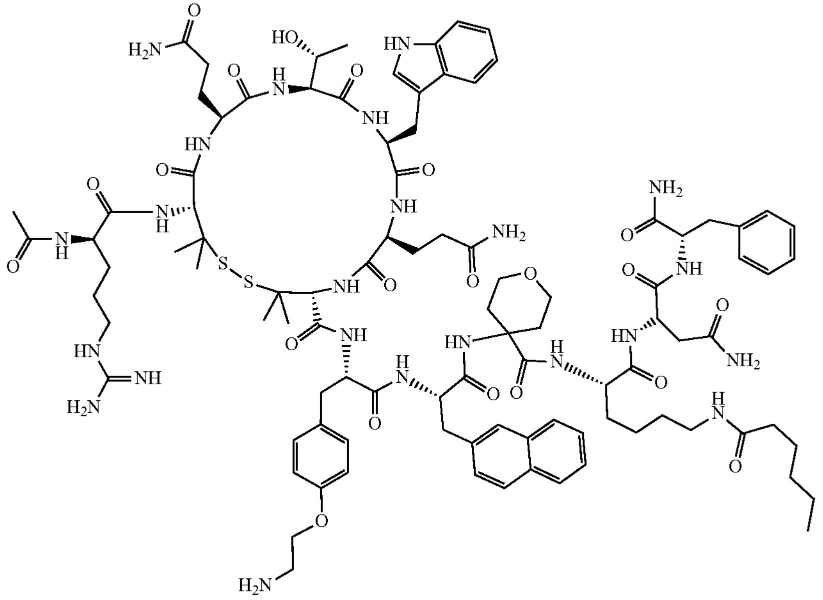<br>MeCO-r-Pen(3)-Q-T-W-Q-Pen(3)-AEF-2Nal-THP-K(COPent)-N-F-CONH2<br>CCCCCC(NCCCC[C@@H](C(N[C@@H](CC(N)=O)C(N[C@@H](Cc1ccccc1)C(N)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CCC(N)=O)C(N[C@@H]([C@@H](C)O)C(N[C@@H](Cc1c[nH]c2c1cccc2)C(N[C@H]1CCC(N)=O)=O)=O)=O)=O)NC([C@@H](CCCNC(N)=N)NC(C)=O)=O)NC1=O)=O)=O)=O)=O)=O |

TABLE 1M-continued

| SEQ ID | Compounds. Structure Peptide Sequence Smiles |
| --- | --- |
| 284 | 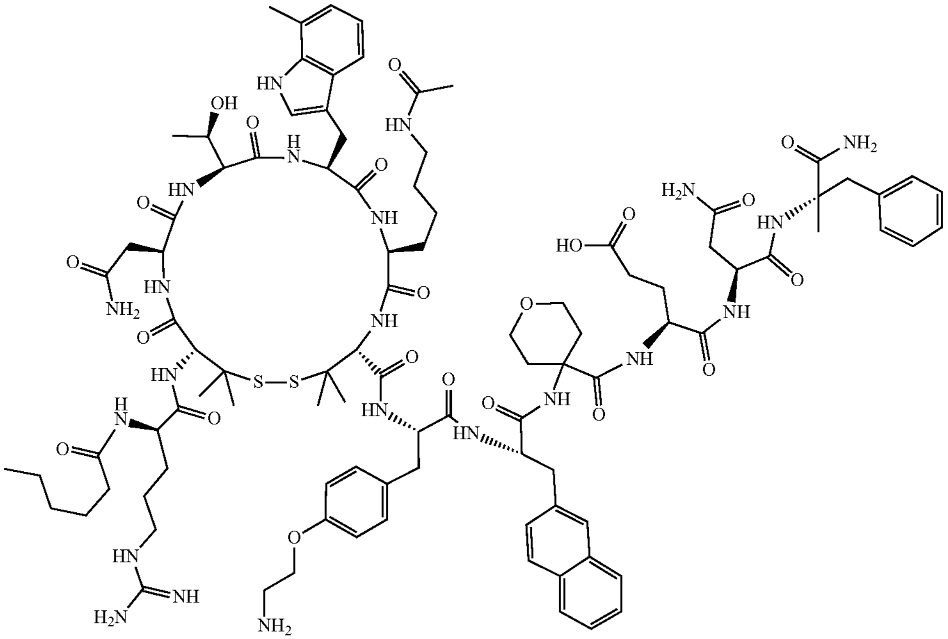 [SMILES: CCCCCC(=O)N[C@H](CCCNC(=N)N)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@](C)(Cc3ccccc3)C(N)=O)CCOCC2)C(C)(C)SSC1(C)C]<br>PentCO-r-Pen(3)-N-T-7MeW-K(Ac)-Pen(3)-AEF-2Nal-THP-E-N-aMePhe-CONH2<br>CCCCCC(N[C@H](CCCNC(N)=N)C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@](C)(Cc1ccccc1)C(N)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O |

TABLE 1M-continued

| Compounds. | |
|---|---|
| SEQ ID | Structure<br>Peptide Sequence<br>Smiles |
| 285 | 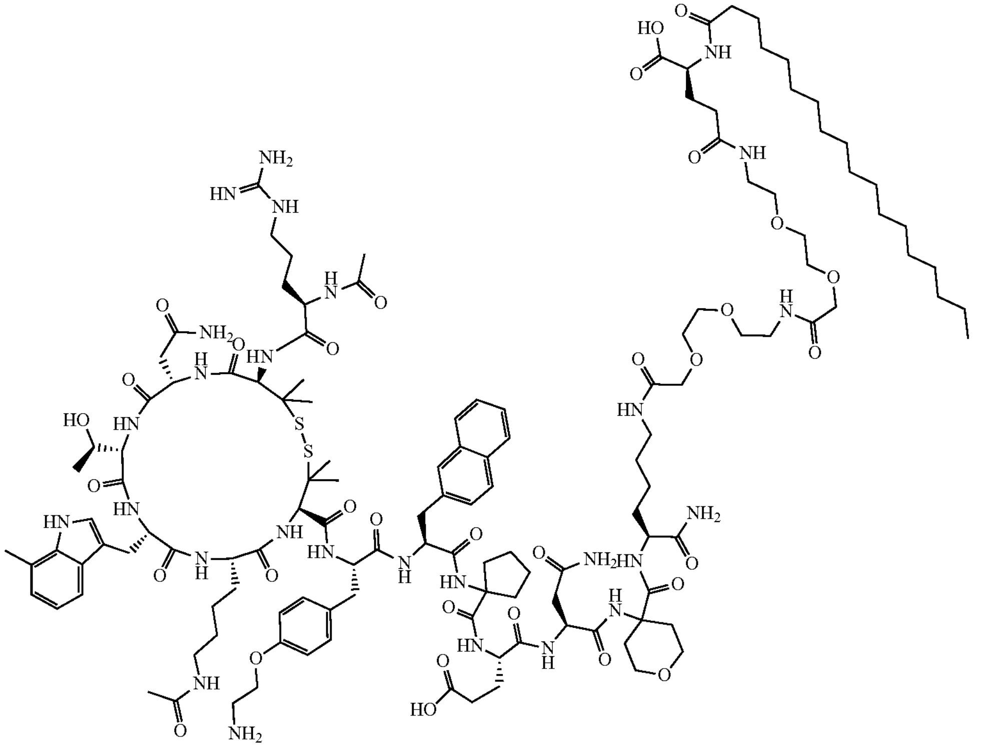 [SMILES: CCCCCCCCCCCCCCCCCC(=O)N[C@@H](CCC(=O)NCCOCCOCC(=O)NCCOCCOCC(=O)NCCCC[C@H](NC(=O)C1(NC(=O)[C@H](CC(N)=O)NC(=O)[C@H](CCC(=O)O)NC(=O)C2(NC(=O)[C@H](Cc3ccc4ccccc4c3)NC(=O)[C@H](Cc3ccc(OCCN)cc3)NC(=O)[C@H]3NC(=O)[C@H](CCCCNC(C)=O)NC(=O)[C@H](Cc4c[nH]c5c(C)cccc45)NC(=O)[C@H]([C@@H](C)O)NC(=O)[C@H](CC(N)=O)NC(=O)[C@@H](NC(=O)[C@@H](CCCNC(=N)N)NC(C)=O)C(C)(C)SSC3(C)C)CCCC2)CCOCC1)C(N)=O)C(=O)O]<br>MeCO-r-Pen(3)-N-T-7MeW-K(Ac)-Pen(3)-AEF-2Nal-Acpx-E-N-THP-K(PEG2PEG2gEC18)-CONH2<br>CCCCCCCCCCCCCCCCCC(N[C@@H](CCC(NCCOCCOCC(NCCOCCOCC(NCCCC[C@@H](C(N)=O)NC(C1(CCOCC1)NC([C@H](CC(N)=O)NC([C@H](CCC(O)=O)NC(C1(CCCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC([C@@H](CCCNC(N)=N)NC(C)=O)=O)NC1=O)=O)=O)=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 286 | 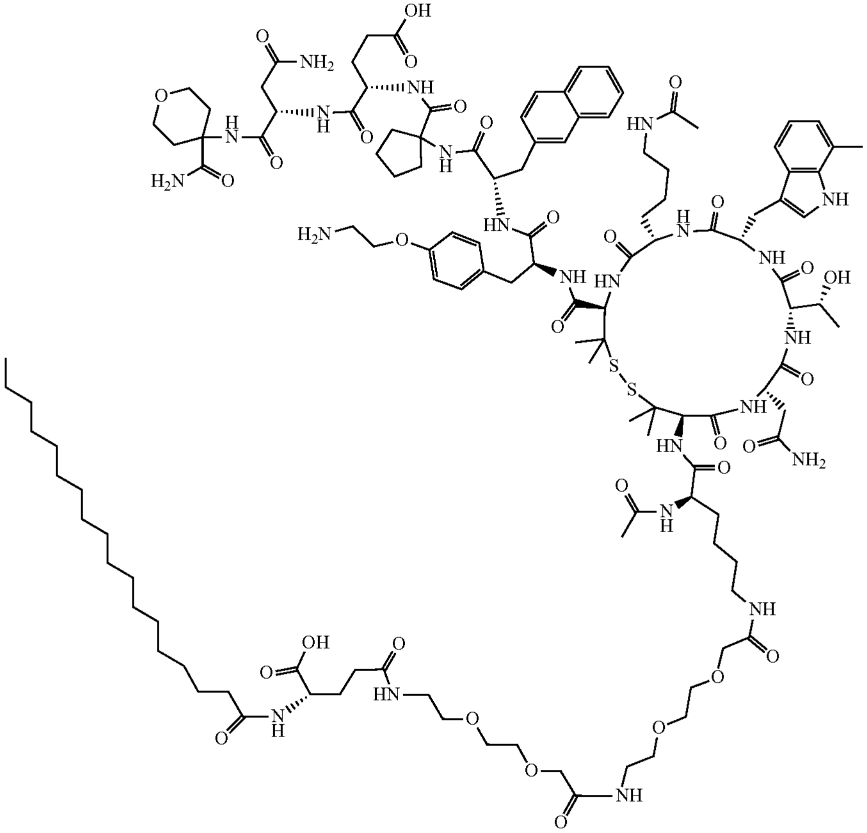 [SMILES: CCCCCCCCCCCCCCCCCC(=O)N[C@@H](CCC(=O)NCCOCCOCC(=O)NCCOCCOCC(=O)NCCCC[C@@H](NC(C)=O)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)NC3(C(N)=O)CCOCC3)CCCC2)C(C)(C)SSC1(C)C)C(=O)O]<br>MeCO-k(PEG2PEG2gEC18)-Pen(3)-N-T-7MeW-K(Ac)-Pen(3)-AEF-2Nal-Acpx-E-N-THP-CONH2<br>CCCCCCCCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCCC1)C(N[C@@H](CCC(O)=O)C(N[C@@H](CC(N)=O)C(NC1(CCOCC1)C(N)=O)=O)=O)=O)=O)=O)=O)NC([C@H](CCCCNC(C)=O)NC([C@H](Cc1c[nH]c2c1cccc2C)NC([C@H]([C@@H] |

TABLE 1M-continued
| SEQ ID | Compounds. Structure Peptide Sequence Smiles |
| --- | --- |
| | (C)O)NC([C@H](CC(N)=O)N1)=O)=O)=O)=O)C1=O)=O)NC(C)=O)=O)=O)=O)C (O)=O)=O |
| 287 | 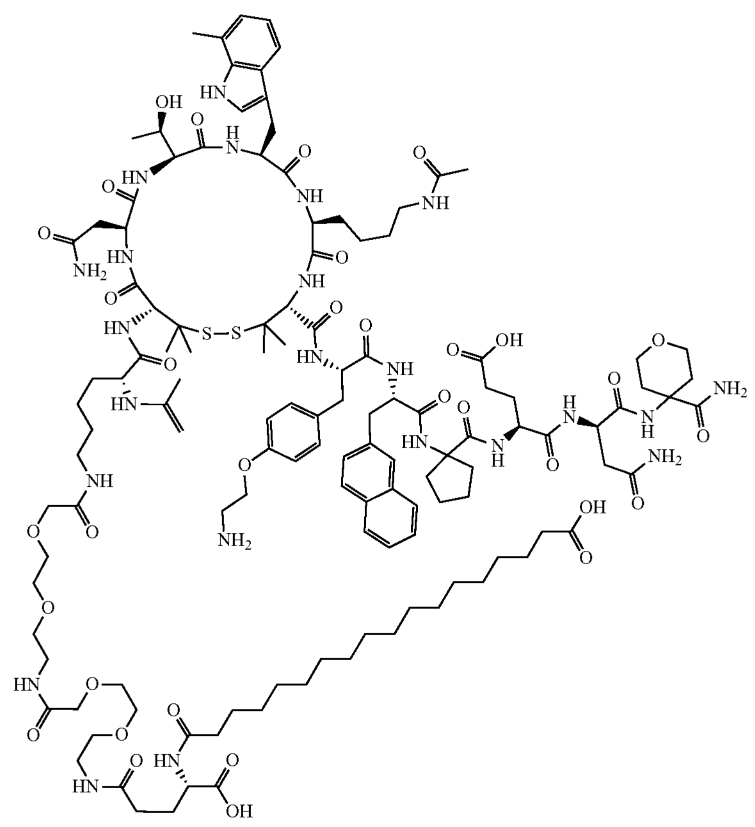 [SMILES: C=C(C)N[C@H](CCCCNC(=O)COCCOCCNC(=O)COCCOCCNC(=O)CC[C@H](NC(=O)CCCCCCCCCCCCCCCCC(=O)O)C(=O)O)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@H](CC(N)=O)C(=O)NC3(C(N)=O)CCOCC3)CCCC2)C(C)(C)SSC1(C)C] MeCO-k(PEG2PEG2gEC18OH)-Pen(3)-N-T-7MeW-K(Ac)-Pen(3)-AEF-2Nal-Acpx-E-N-THP-CONH2 C[C@H]([C@@H](C(N[C@@H](Cc1c[nH]c2c1cccc2C)C(N[C@@H](CCCCNC (C)=O)C(N[C@@H](C(C)(C)SSC(C)(C)[C@@H](C(N[C@H]1CC(N)=O)=O)NC ([C@@H](CCCCNC(COCCOCCNC(COCCOCCNC(CC[C@@H](C(O)=O)NC(CC |

TABLE 1M-continued

| SEQ ID | Compounds. Structure Peptide Sequence Smiles |
|---|---|
| | CCCCCCCCCCCCCCCC(O)=O)=O)=O)=O)=O)NC(C)=O)=O)C(N[C@@H](Cc(cc 2)ccc2OCCN)C(N[C@@H](Cc2cc3ccccc3cc2)C(NC2(CCCC2)C(N[C@@H](CCC (O)=O)C(N[C@@H](CC(N)=O)C(NC2(CCOCC2)C(N)=O)=O)=O)=O)=O)=O)= O)=O)=O)=O)NC1=O)O |
| 288 | 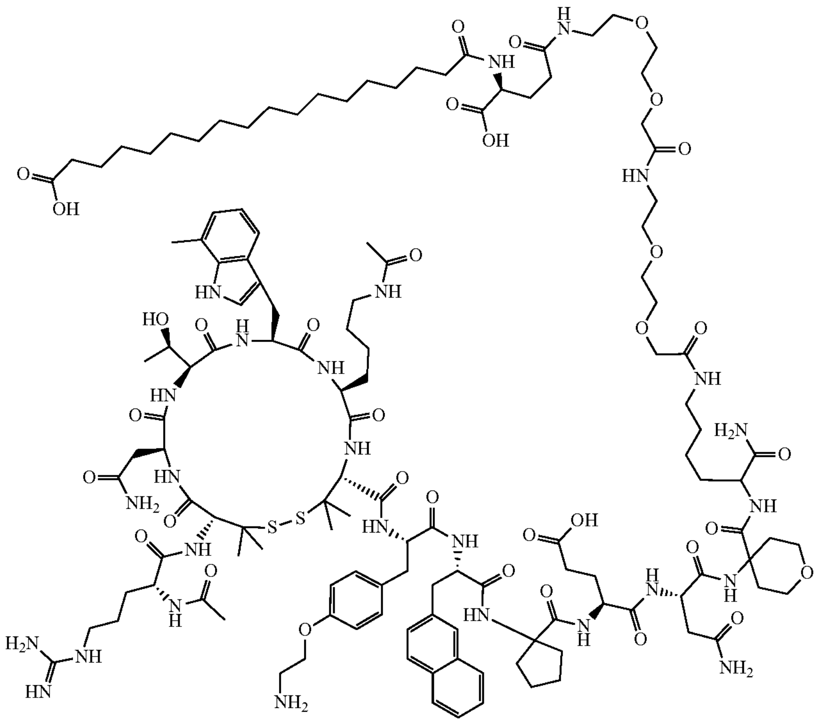 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)NC3(C(=O)NC(CCCCNC(=O)COCCOCCNC(=O)COCCOCCNC(=O)CC[C@H](NC(=O)CCCCCCCCCCCCCCCCC(=O)O)C(=O)O)C(N)=O)CCOCC3)CCCC2)NC1=O] MeCO-r-Pen(3)-N-T-7MeW-K(Ac)-Pen(3)-AEF-2Nal-Acpx-E-N-THP-K(PEG2PEG2gEC18OH)-CONH2 C[C@H]([C@@H](C(N[C@@H](Cc1c[nH]c2c1cccc2C)C(N[C@@H](CCCCNC (C)=O)C(N[C@@H](C(C)(C)SSC(C)(C)[C@@H](C(N[C@H]1CC(N)=O)=O)NC ([C@@H](CCCNC(N)=N)NC(C)=O)=O)C(N[C@@H](Cc(cc2)ccc2OCCN)C(N[C@ @H](Cc2cc3ccccc3cc2)C(NC2(CCCC2)C(N[C@@H](CCC(O)=O)C(N[C@@H](C C(N)=O)C(NC2(CCOCC2)C(N[C@@H](CCCCNC(COCCOCCNC(COCCOCCN |

TABLE 1M-continued

| SEQ ID | Compounds. Structure Peptide Sequence Smiles |
|---|---|
| | C(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)NC1=O)O |
| 289 | 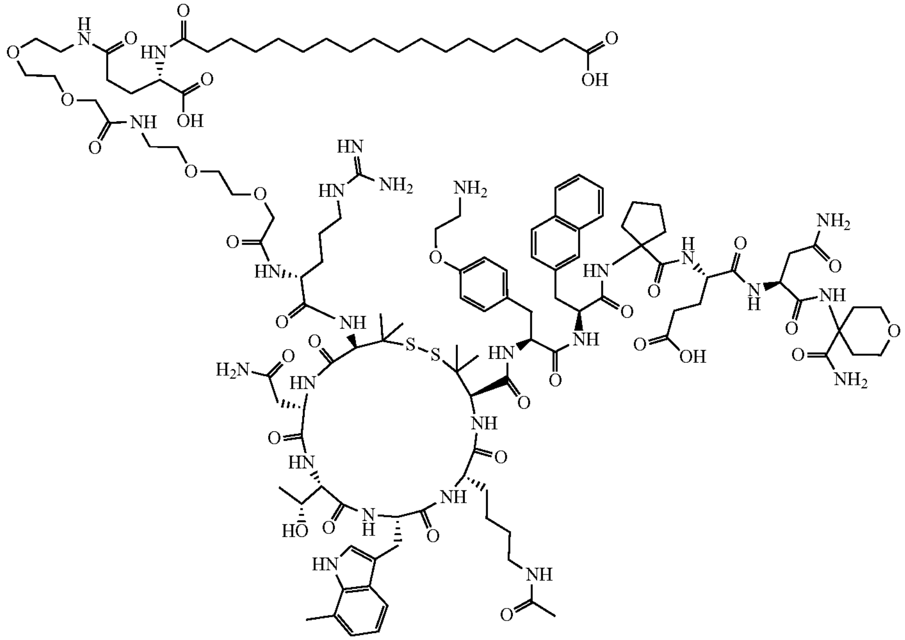 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(=O)COCCOCCNC(=O)COCCOCCNC(=O)CC[C@H](NC(=O)CCCCCCCCCCCCCCCCC(=O)O)C(=O)O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)NC3(C(N)=O)CCOCC3)CCCC2)NC1=O]<br>HOC18gEPEG2PEG2CO-r-Pen(3)-N-T-7MeW-K(Ac)-Pen(3)-AEF-2Nal-Acpx-E-N-THP-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@](C(N[C@H]1CC(N)=O)=O)NC([C@@H])CCCNC(N)=N)NC(COCCOCCNC(COCCOCCNC(CC[C@@H](C(O)=O)NC(CCCCCCCCCCCCCCCCC(O)=O)=O)=O)=O)=O)=O)C(N[C@@H](Cc(cc2)ccc2OCCN)C(N[C@@H](Cc2cc3ccccc3cc2)C(NC2(CCC2)C(N[C@@H](CCC(O)=O)C(N[C@@H](CC(N)=O)C(NC2(CCOCC2)C(N)=O)=O)=O)=O)=O)=O)=O)=O))=O)=O)NC1=O)O |

TABLE 1M-continued
| Compounds. | |
|---|---|
| SEQ ID | Structure<br>Peptide Sequence<br>Smiles |
| 290 | 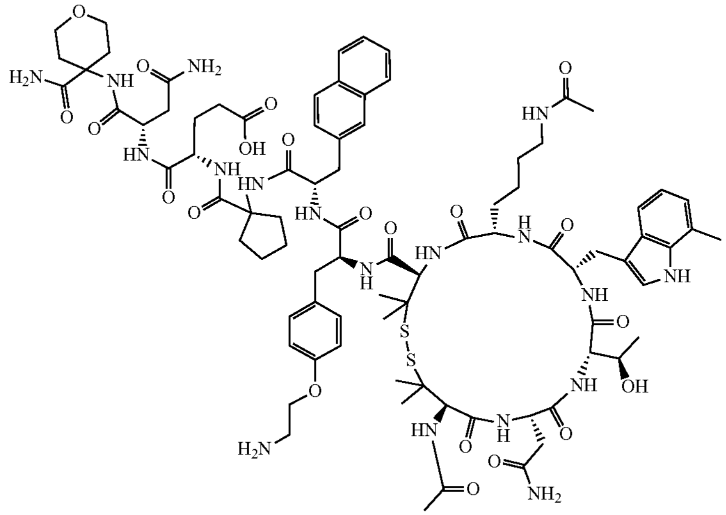 |

TABLE 1M-continued

| Compounds. | |
|---|---|
| SEQ ID | Structure<br>Peptide Sequence<br>Smiles |
| | 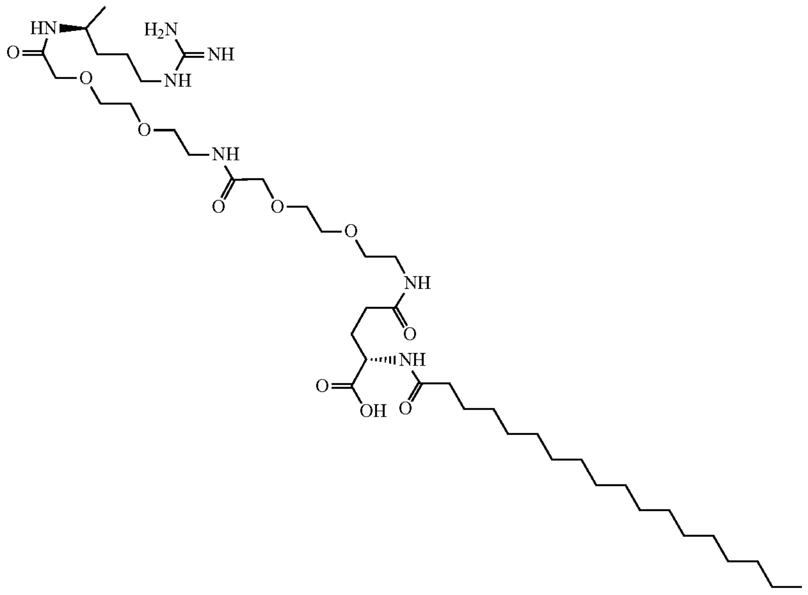<br>C18gEPEG2PEG2CO-r-Pen(3)-N-T-7MeW-K(Ac)-Pen(3)-AEF-2Nal-Acpx-E-N-THP-CONH2<br>CCCCCCCCCCCCCCCCCC(N[C@@H](CCC(NCCOCCOCC(NCCOCCOCC(N[C@H](CCCNC(N)=N)C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCCC1)C(N[C@@H](CCC(O)=O)C(N[C@@H](CC(N)=O)C(NC1(CCOCC1)C(N)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)=O)C(O)=O)=O |

TABLE 1M-continued
| Compounds. | |
|---|---|
| SEQ ID | Structure<br>Peptide Sequence<br>Smiles |
| 291 | 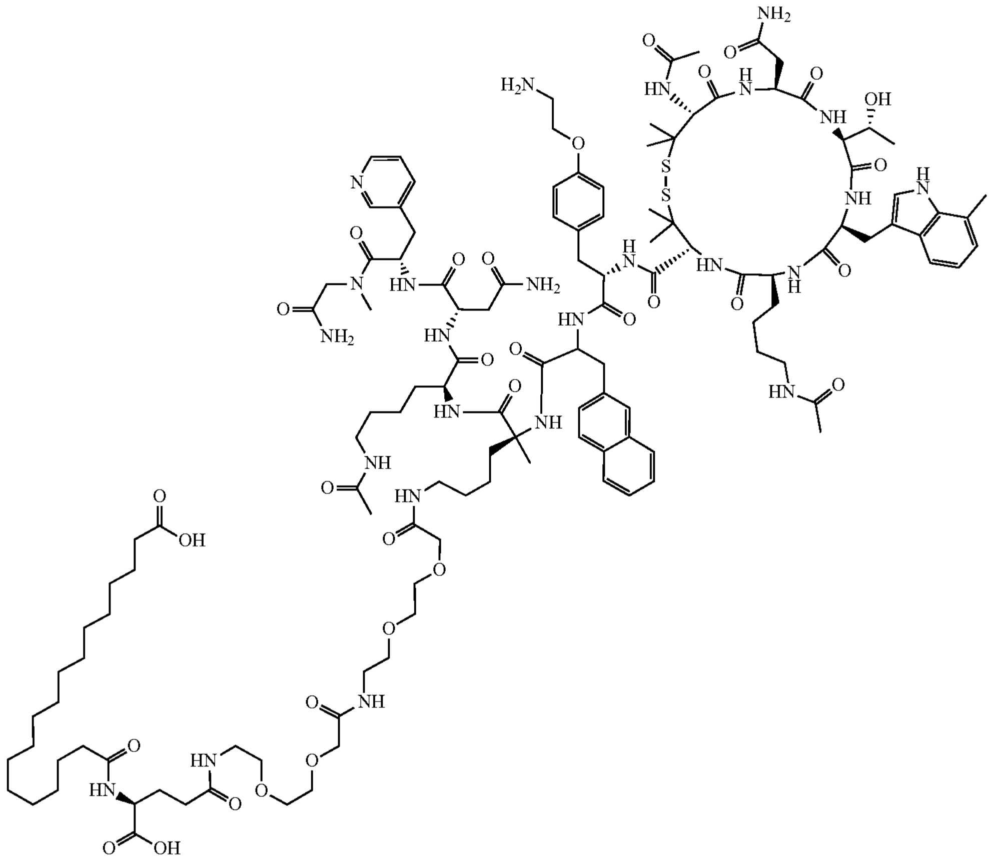 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)NC(Cc2ccc3ccccc3c2)C(=O)N[C@@](C)(CCCCNC(=O)COCCOCCNC(=O)COCCOCCNC(=O)CC[C@H](NC(=O)CCCCCCCCCCCCCCCCC(=O)O)C(=O)O)C(=O)N[C@@H](CCCCNC(C)=O)C(=O)N[C@@H](CC(N)=O)C(=O)N[C@@H](Cc2cccnc2)C(=O)N(C)CC(N)=O)NC1=O]<br>MeCO-Pen(3)-N-T-7MeW-K(Ac)-Pen(3)-AEF-2Nal-aMeK(PEG2PEG2gEC18OH)-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(N[C@@](C)(CCCCNC(COCCOCCNC(COCCOCCNC(CC[C@@H](C(O)=O)NC(CCCC |

TABLE 1M-continued
| Compounds. | |
|---|---|
| SEQ ID | Structure<br>Peptide Sequence<br>Smiles |
| | CCCCCCCCCCCCC(O)=O)=O)=O)=O)=O)=O)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)O |
| 292 | 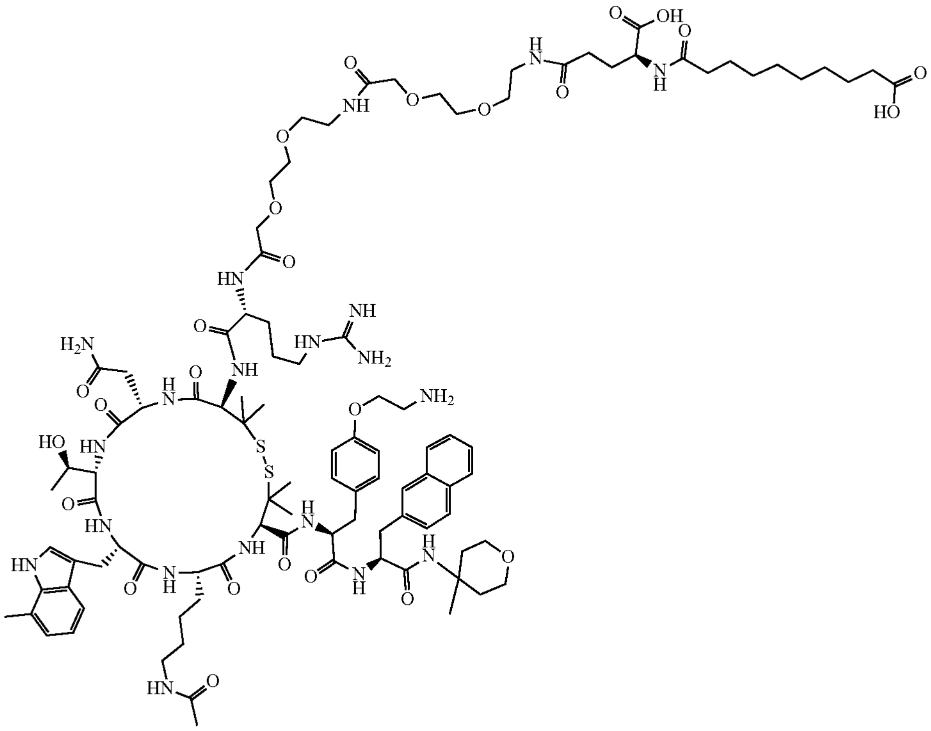 |

TABLE 1M-continued

| Compounds. | |
|---|---|
| SEQ ID | Structure<br>Peptide Sequence<br>Smiles |
| | 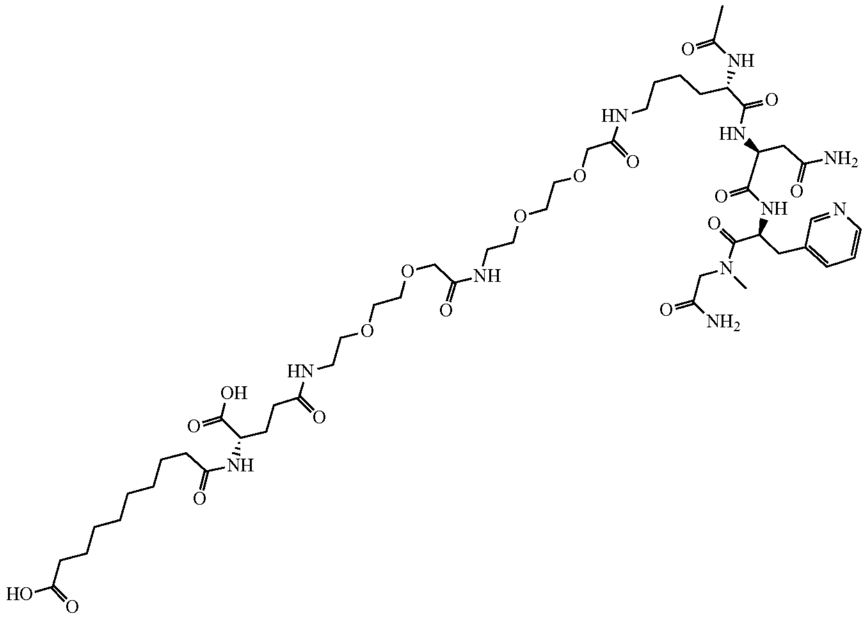<br>HOC10gEPEG2PEG2CO-r-Pen(3)-N-T-7MeW-K(Ac)-Pen(3)-AEF-2Nal-THP-K(PEG2PEG2gEC10OH)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(COCCOCCNC(COCCOCCNC(CC[C@@H](C(O)=O)NC(CCCCCCCCCC(O)=O)=O)=O)=O)=O)=O)C(N[C@@H](Cc(cc2)ccc2OCCN)C(N[C@@H](Cc2cc3ccccc3cc2)C(NC2(CCOCC2)C(N[C@@H](CCCCNC(COCCOCCNC(COCCOCCNC(CC[C@@H](C(O)=O)NC(CCCCCCCCCC(O)=O)=O)=O)=O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 293 | 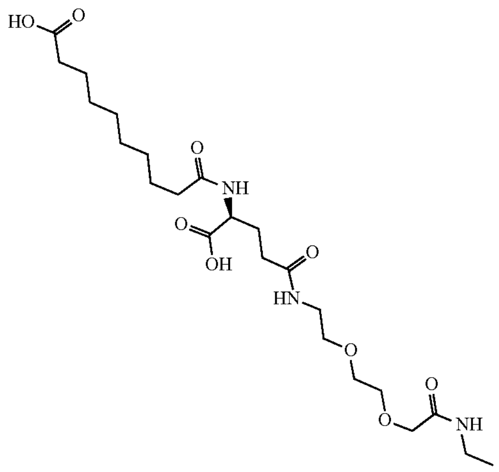 |

TABLE 1M-continued

| SEQ ID | Compounds. Structure Peptide Sequence Smiles |
|---|---|
| | 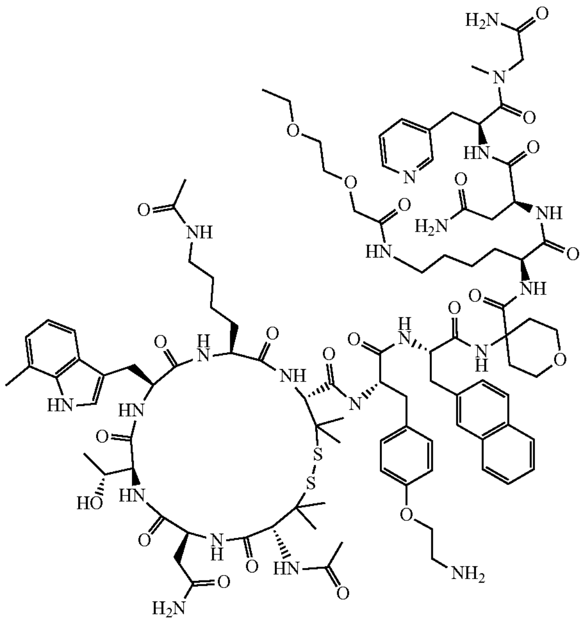<br>MeCO-Pen(3)-N-T-7MeW-K(Ac)-Pen(3)-AEF-2Nal-THP-K(PEG2PEG2gEC10OH)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(COCCOCCNC(COCCOCCNC(CC[C@@H](C(O)=O)NC(CCCCCCCCCC(O)=O)=O)=O)=O)=O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 294 | 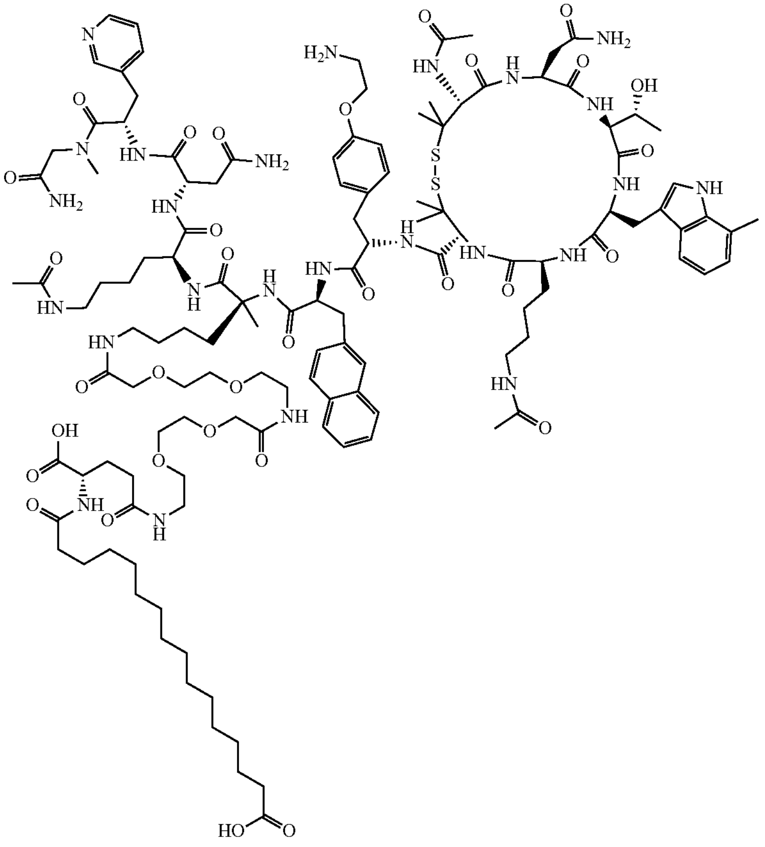<br>MeCO-Pen(3)-N-T-7MeW-K(Ac)-Pen(3)-AEF-2Nal-aMeK(PEG2PEG2gEC16OH)-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(N[C@@](C)(CCCCNC(COCCOCCNC(COCCOCCNC(CC[C@@H](C(O)=O)NC(CCCCCCCCCCCCCCC(O)=O)=O)=O)=O)=O)=O)C(N[C@@H](CCCCNC(C)=O)C(N[C@ |

TABLE 1M-continued
| Compounds. | |
|---|---|
| SEQ ID | Structure<br>Peptide Sequence<br>Smiles |
| | @H](CC(N)=O)C(N[C@@H](Cc2cnccc2)C(N(C)CC(N)=O)=O)=O)=O)=O)=O)=O)=O)=O)=O)=O)=O)NC1=O)O |
| 295 | 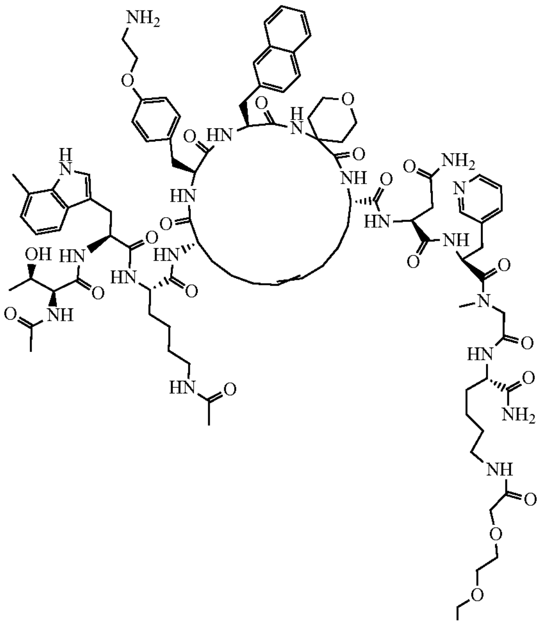 |

TABLE 1M-continued

| Compounds. | |
|---|---|
| SEQ ID | Structure<br>Peptide Sequence<br>Smiles |
| | 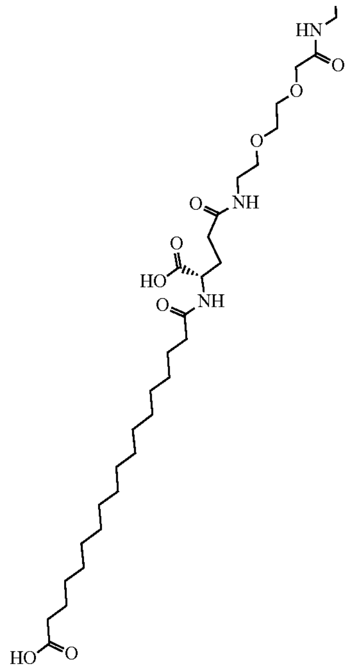<br>MeCO-T-7MeW-K(Ac)-S5H(4)-AEF-2Nal-THP-S5H(4)-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](CCC/C=C\CCC[C@@H](C(N[C@@H](CC(N)=O)C(N[C@@H](Cc1cnccc1)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)NC(C1(CCOCC1)NC([C@H](Cc1cc2ccccc2cc1)NC([C@H](Cc(cc1)ccc1OCCN)N1)=O)=O)=O)C1=O)=O)=O)=O)NC(C)=O)O |

TABLE 1M-continued
| Compounds. | |
|---|---|
| SEQ ID | Structure<br>Peptide Sequence<br>Smiles |
| 296 | 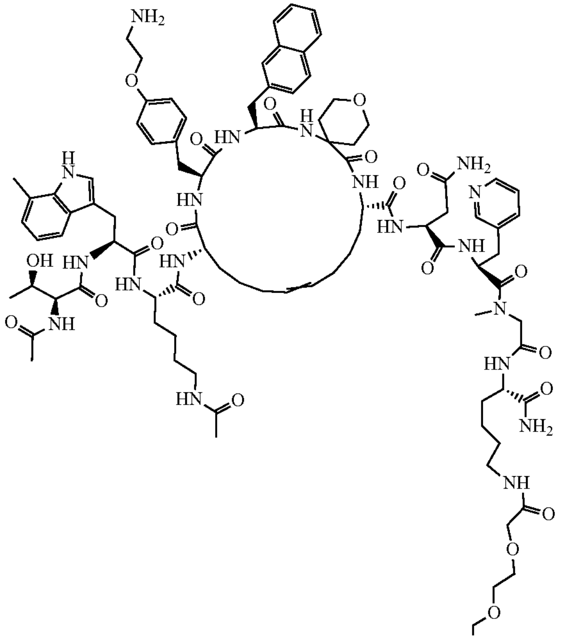 |

TABLE 1M-continued

| Compounds. | |
|---|---|
| SEQ ID | Structure<br>Peptide Sequence<br>Smiles |
| | 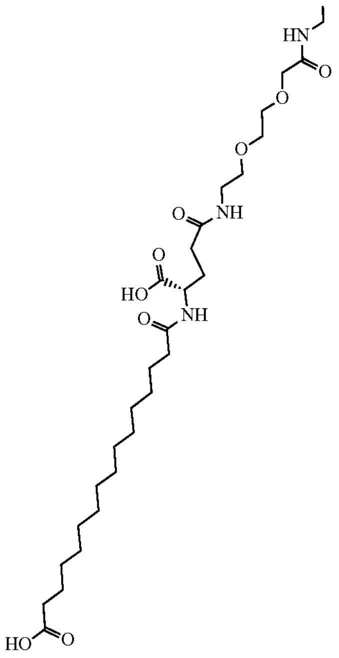<br>MeCO-T-7MeW-K(Ac)-S5H(4)-AEF-2Nal-THP-S5H(4)-N-3Pya-Sar-K(PEG2PEG2gEC16OH)-CONH2<br>C[C@H]([C@@H](C(N[C@@H](Cc1c[nH]c2c1cccc2C)C(N[C@@H](CCCCNC(C)=O)C(N[C@@H](CCC/C-C\CCC[C@@H](C(N[C@@H](CC(N)=O)C(N[C@@H](Cc1cnccc1)C(N(C)CC(N[C@@H](CCCCNC(COCCOCCNC(COCCOCCNC(CC[C@@H](C(O)=O)NC(CCCCCCCCCCCCCCCC(O)=O)=O)=O)=O)=O)=O)C(N)=O)=O)=O)=O)=O)=O)NC(C1(CCOCC1)NC([C@H](Cc1cc2ccccc2cc1)NC([C@H](Cc(cc1)ccc1OCCN)N1)=O)=O)=O)C1=O)=O)=O)=O)NC(C)=O)O |

TABLE 1M-continued
| Compounds. | |
|---|---|
| SEQ ID | Structure<br>Peptide Sequence<br>Smiles |
| 297 | 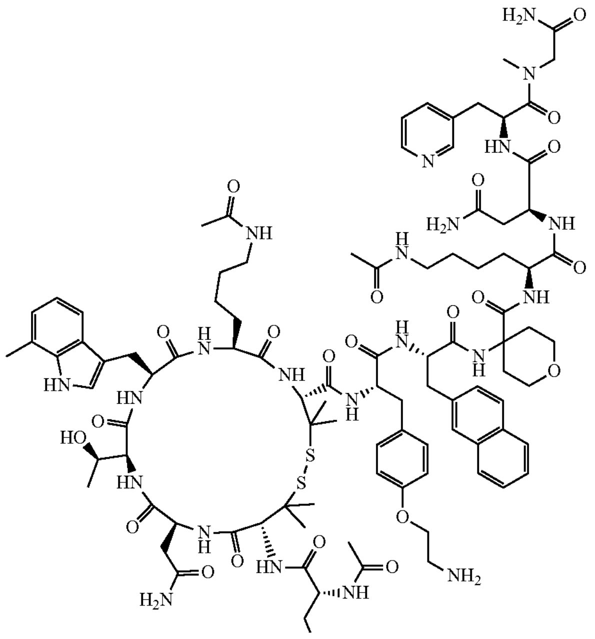 |

TABLE 1M-continued

| Compounds. | |
|---|---|
| SEQ ID | Structure<br>Peptide Sequence<br>Smiles |
| | 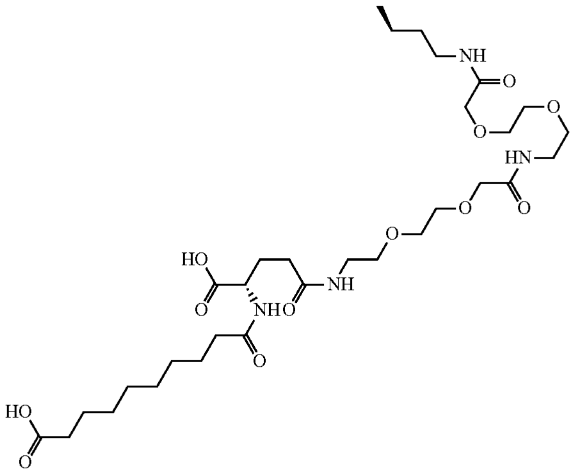<br>MeCO-k(PEG2PEG2gEC10OH)-Pen(3)-N-T-7MeW-K(Ac)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCC(O)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| SEQ ID | Compounds. Structure Peptide Sequence Smiles |
|---|---|
| 298 | 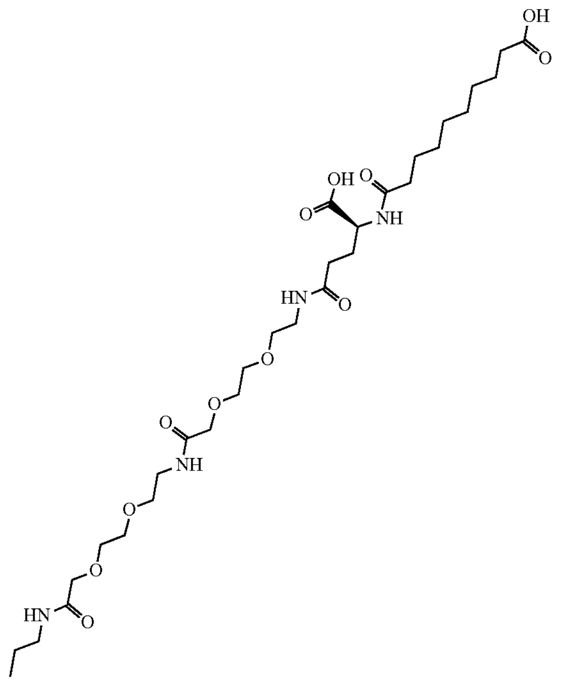 |

TABLE 1M-continued

| Compounds. | |
|---|---|
| SEQ ID | Structure<br>Peptide Sequence<br>Smiles |
| | 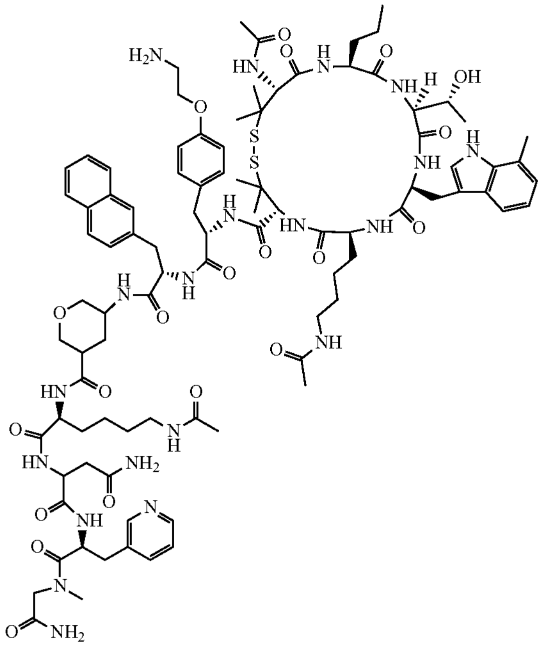<br>MeCO-Pen(3)-K(PEG2PEG2gEC10OH)-T-7MeW-K(Ac)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCC(O)=O)=O)=O)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued

| SEQ ID | Compounds. Structure Peptide Sequence Smiles |
|---|---|
| 299 | 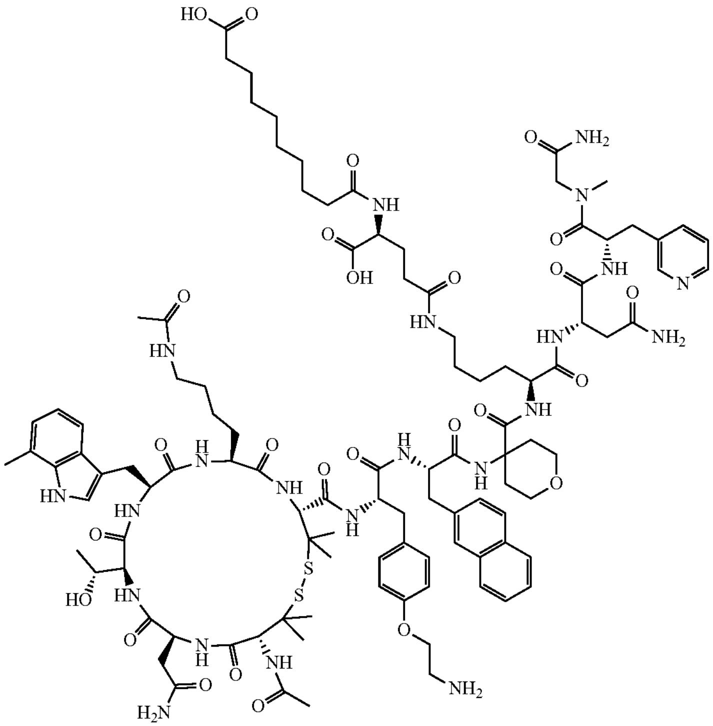 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(=O)CC[C@H](NC(=O)CCCCCCCCC(=O)O)C(=O)O)C(=O)N[C@@H](CC(N)=O)C(=O)N[C@@H](Cc3cccnc3)C(=O)N(C)CC(N)=O)CCOCC2)NC1=O]<br>MeCO-Pen(3)-N-T-7MeW-K(Ac)-Pen(3)-AEF-2Nal-THP-K(gEC10OH)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(CC[C@@H](C(O)=O)NC(CCCCCCCCC(O)=O)=O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued

Compounds.

| SEQ ID | Structure<br>Peptide Sequence<br>Smiles |
|---|---|
| 300 | 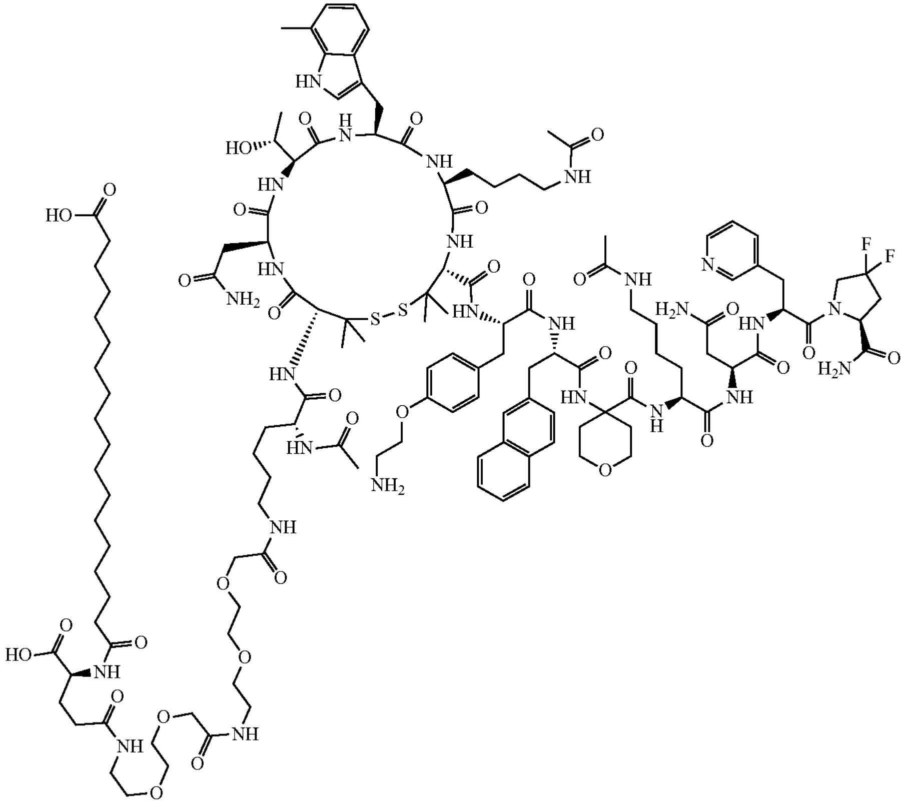 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)COCCOCCNC(=O)COCCOCCNC(=O)CC[C@H](NC(=O)CCCCCCCCCCCCCCCCC(=O)O)C(=O)O)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N3CC(F)(F)C[C@H]3C(N)=O)CCOCC2)NC1=O]<br>MeCO-k(PEG2PEG2gEC18OH)-Pen(3)-N-T-7MeW-K(Ac)-Pen(3)-AEF-2Nal-THP-K(Ac)-N-3Pya-4diFPro-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(CC(C2)(F)F)[C@@H]2C(N)=O)=O)=O)=O)=O)=O)=O)=O)=O)=O)NC1=O)O |

TABLE 1M-continued

| SEQ ID | Compounds. Structure Peptide Sequence Smiles |
|---|---|
| 301 | 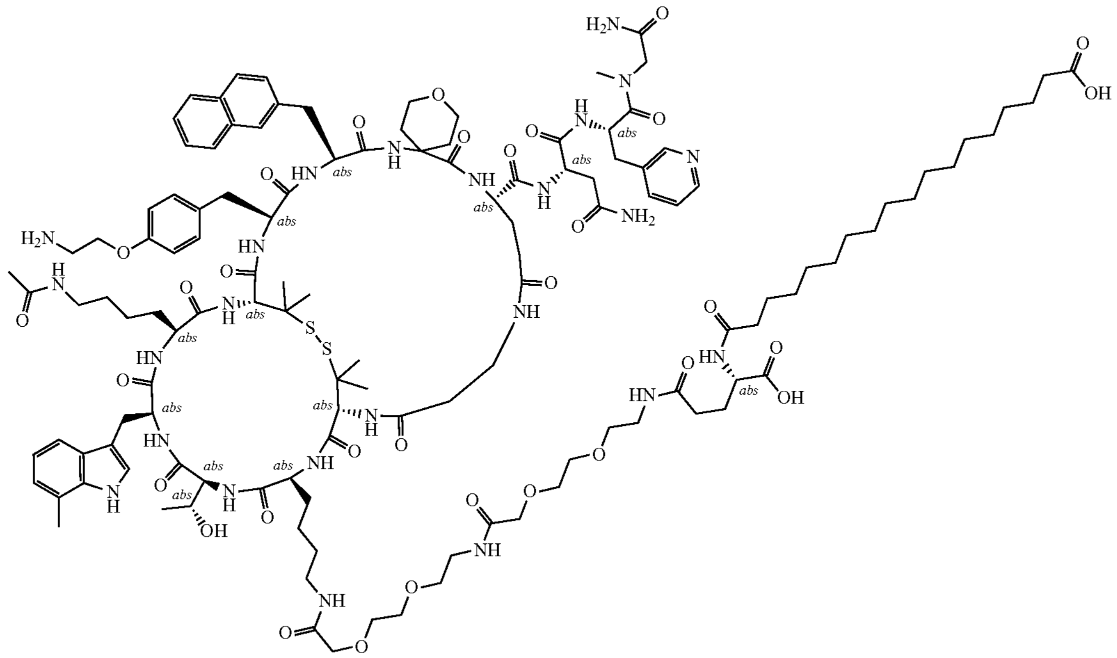<br>7Ahp(2)-Pen(3)-K(PEG2PEG2gEC18OH)-T-7MeW-K(Ac)-Pen(3)-AEF-2Nal-THP-E(2)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC(CCCCCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued
| Compounds. | |
|---|---|
| SEQ ID | Structure<br>Peptide Sequence<br>Smiles |
| 302 | 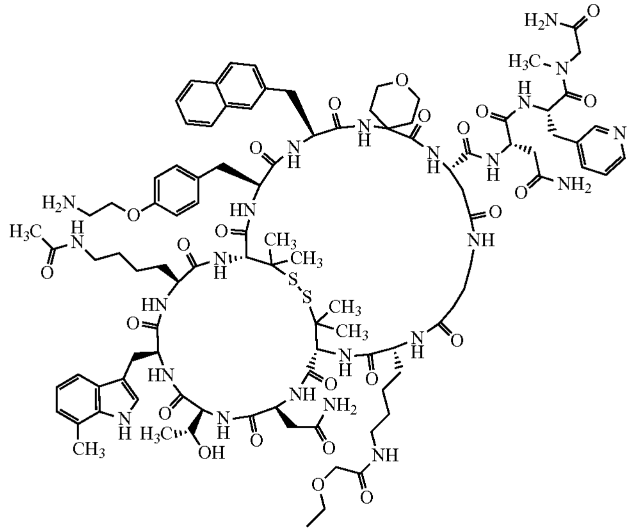 |

TABLE 1M-continued

| SEQ ID | Compounds.<br>Structure<br>Peptide Sequence<br>Smiles |
|---|---|
| | 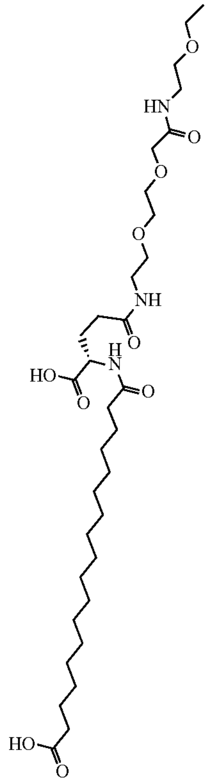<br>GABA(2)-k(PEG2PEG2gEC18OH)-Pen(3)-N-T-7MeW-K(Ac)-Pen(3)-AEF-2Nal-THP-E(2)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)=O)NC(CCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)=O)C2=O)=O)=O)=O)NC1=O)O |

TABLE 1M-continued
| SEQ ID | Compounds. Structure Peptide Sequence Smiles |
| --- | --- |
| 303 | 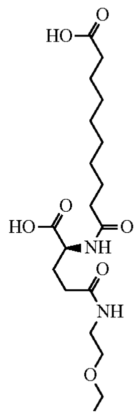 |

TABLE 1M-continued
| Compounds. | |
|---|---|
| SEQ ID | Structure<br>Peptide Sequence<br>Smiles |
| | 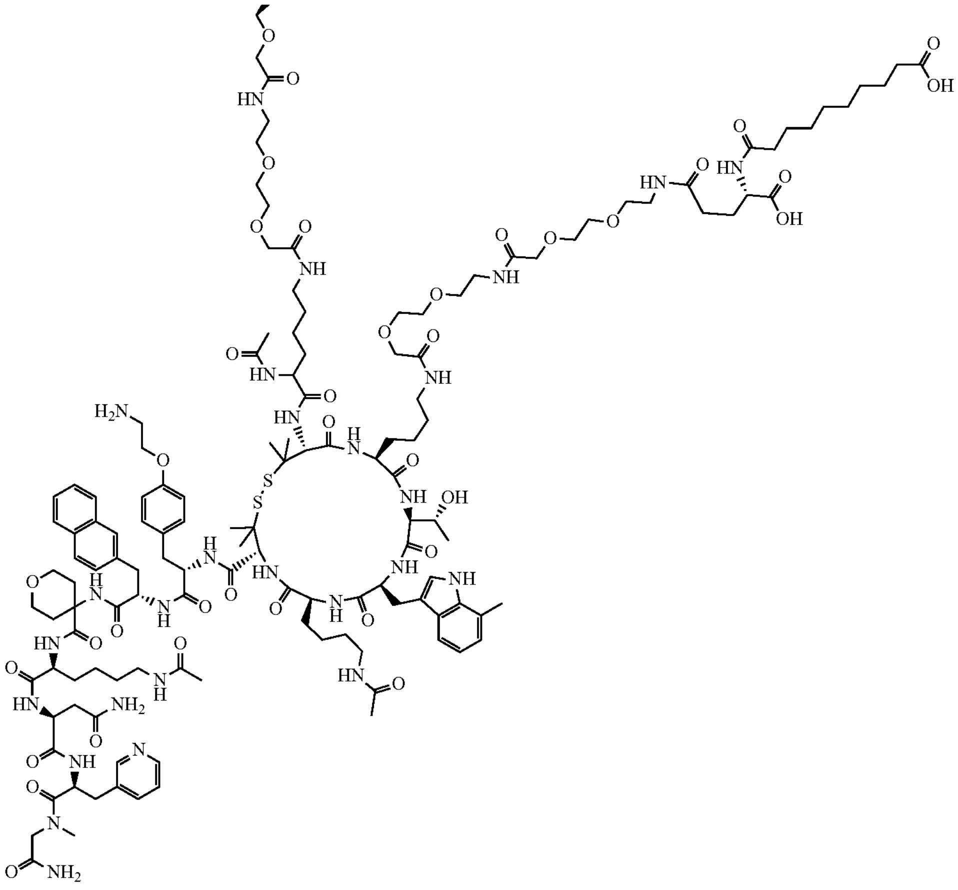<br>MeCO-k(PEG2PEG2gEC10OH)-Pen(3)-K(PEG2PEG2gEC10OH)-T-7MeW-K(Ac)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCC(O)=O)=O)=O)=O)= |

TABLE 1M-continued
| SEQ ID | Compounds. Structure Peptide Sequence Smiles |
|---|---|
| 304 | O)=O)=O)NC([C@@H](CCCCNC(COCCOCCNC(COCCOCCNC(CC[C@@H](C(O)=O)NC(CCCCCCCCCC(O)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O 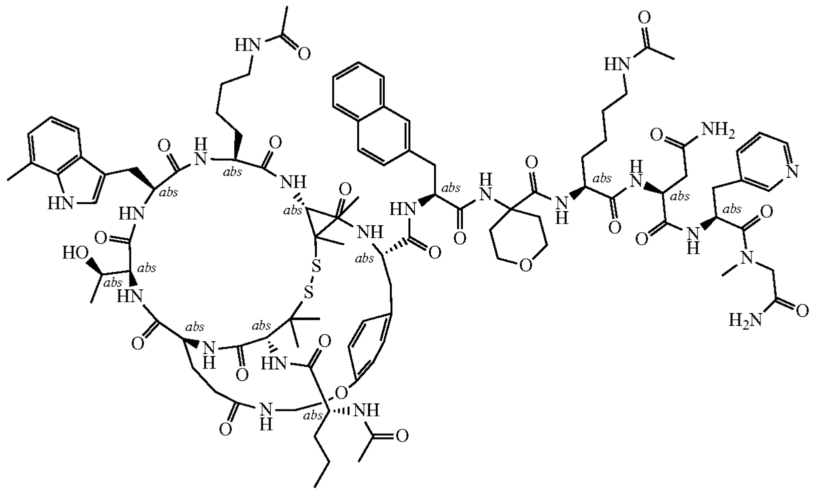 |

TABLE 1M-continued

| SEQ ID | Compounds. Structure Peptide Sequence Smiles |
|---|---|
| | 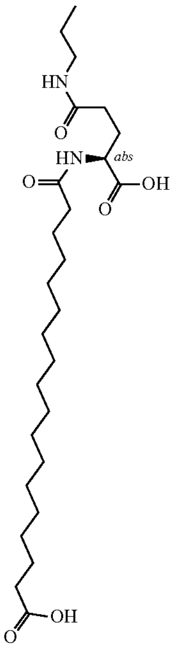 MeCO-k(PEG2PEG2gEC18OH)-Pen(3)-E(2)-T-7MeW-K(Ac)-Pen(3)-AEF(2)-2Nal-THP-K(Ac)-N-3Pya-Sar-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCCCNC(C)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)NC(C)=O)=O)C3=O)=O)=O)=O)NC1=O)O |

TABLE 1M-continued
| Compounds. | |
|---|---|
| SEQ ID | Structure<br>Peptide Sequence<br>Smiles |
| 305 | 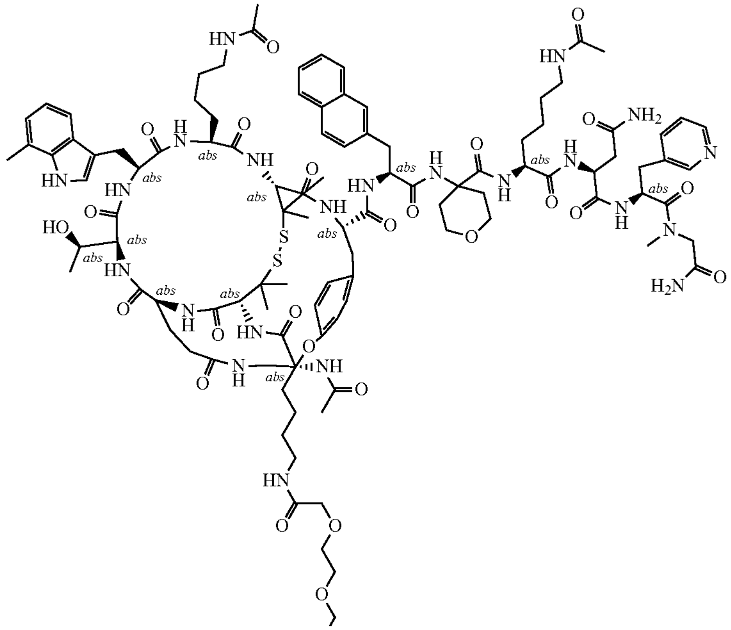 |

TABLE 1M-continued

Compounds.

| SEQ ID | Structure<br>Peptide Sequence<br>Smiles |
|---|---|
| | 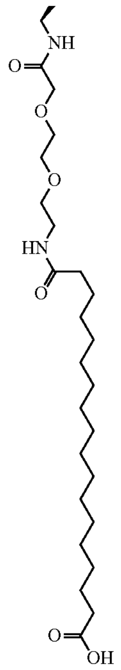<br>MeCO-k(gEC18OH)-Pen(3)-E(2)-T-7MeW-K(Ac)-Pen(3)-AEF(2)-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCCCNC(C)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCCNC(CC[C@@H](C(O)=O)NC(CCCCCCCCCCCCCCCCC(O)=O)=O)=O)NC(C)=O)=O)C3=O)=O)=O)=O)NC1=O)O |

TABLE 1M-continued
| SEQ ID | Compounds. Structure Peptide Sequence Smiles |
|---|---|
| 306 | 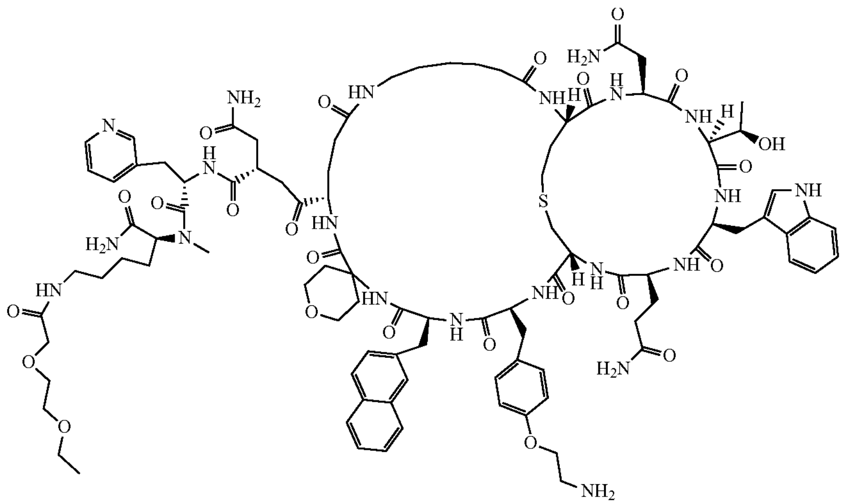 |

TABLE 1M-continued

| Compounds. | |
|---|---|
| SEQ ID | Structure<br>Peptide Sequence<br>Smiles |
| | 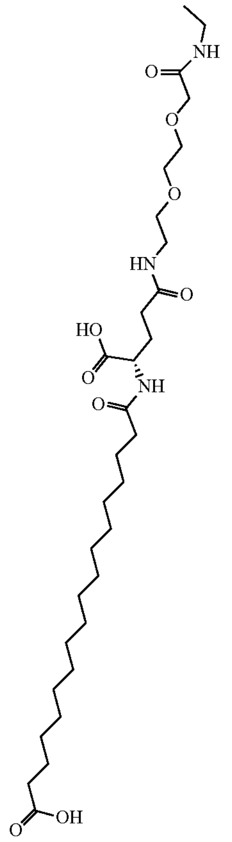 |
| | MeCO-k(PEG2PEG2C18OH)-Pen(3)-E(2)-T-7MeW-K(Ac)-Pen(3)-AEF(2)-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCCCNC(C)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCCNC(COCCOCCNC(CO |

TABLE 1M-continued
| Compounds. | |
|---|---|
| SEQ ID | Structure<br>Peptide Sequence<br>Smiles |
| | CCOCCNC(CCCCCCCCCCCCCCCCCC(O)=O)=O)=O)=O)NC(C)=O)=O)C3=O)=O)=O)=O)NC1=O)O |
| 307 | 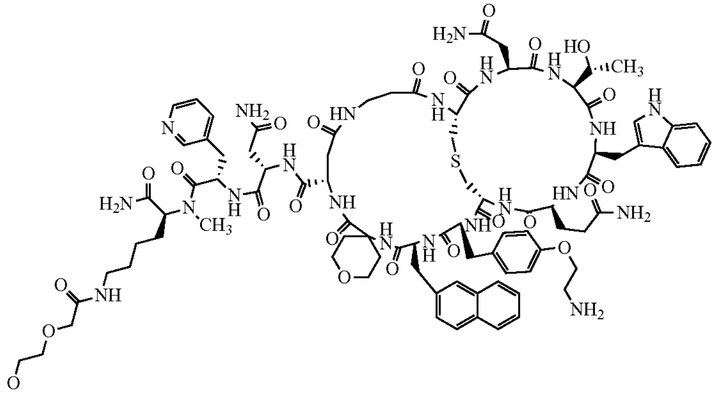 |

TABLE 1M-continued

| Compounds. | |
|---|---|
| SEQ ID | Structure<br>Peptide Sequence<br>Smiles |
| | 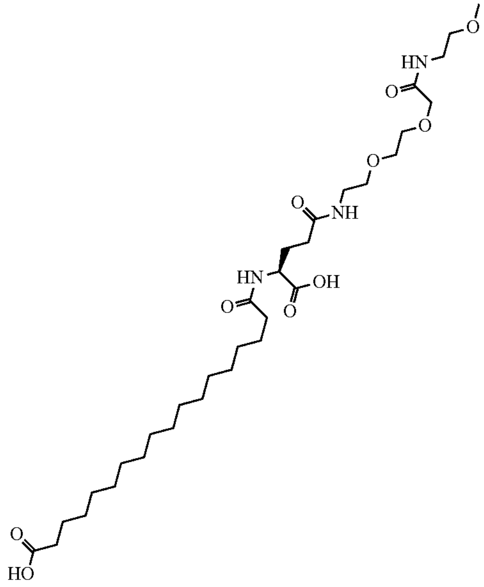<br>6Ahx(2)-Abu(1)-N-T-W-Q-C(1)-AEF-2Nal-THP-E(2)-N-3Pya-NMeK(PEG2PEG2gEC18OH)-CONH2<br>C[C@H]([C@@H](C(N[C@@H](Cc1c[nH]c2c1cccc2)C(N[C@@H](CCC(N)=O)C(N[C@@H](CSCC[C@@H](C(N[C@H]1CC(N)=O)=O)NC(CCCCCNC(CC[C@@H](C(N[C@@H](CC(N)=O)C(N[C@@H](Cc2cnccc2)C(N(C)[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued
| Compounds. | |
|---|---|
| SEQ ID | Structure<br>Peptide Sequence<br>Smiles |
| 308 | 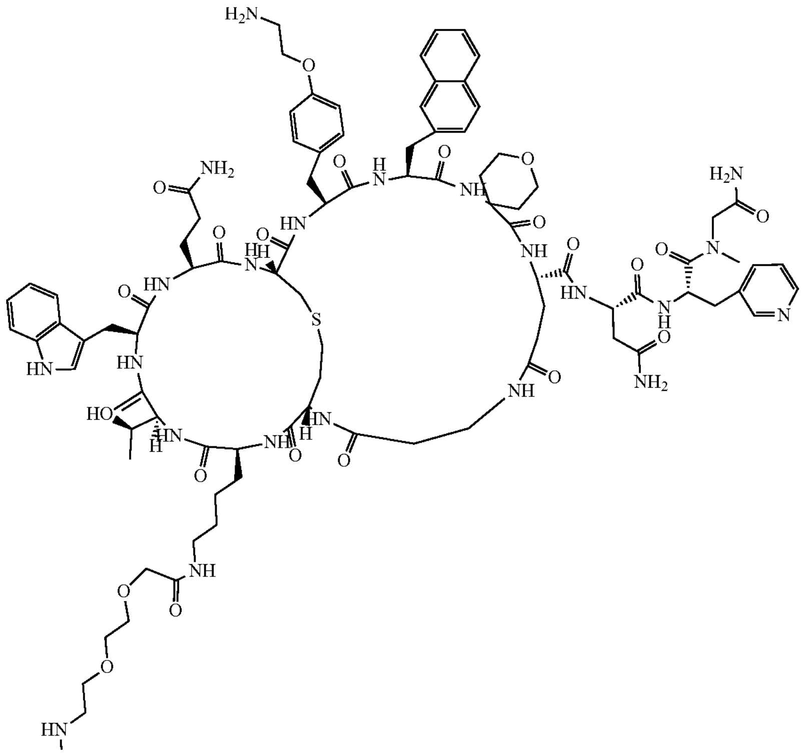 |

TABLE 1M-continued

| Compounds. | |
|---|---|
| SEQ ID | Structure<br>Peptide Sequence<br>Smiles |
| | 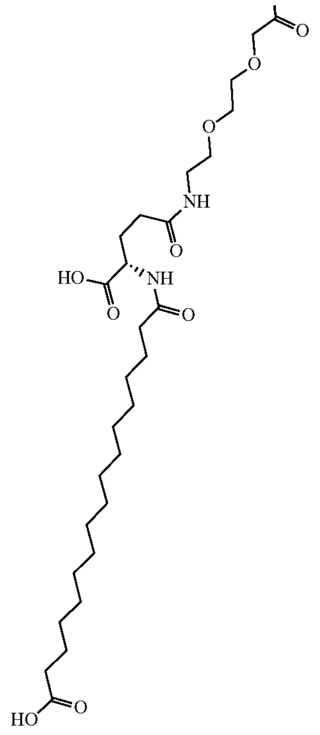<br>6Ahx(2)-Abu(1)-K(PEG2PEG2gEC18OH)-T-W-Q-C(1)-AEF-2Nal-THP-E(2)-N-3Pya-Sar-CONH2<br>C[C@H]([C@@H](C(N[C@@H](Cc1c[nH]c2c1cccc2)C(N[C@@H](CCC(N)=O)C(N[C@@H](CSCC[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC(CCCCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued

| Compounds. | |
|---|---|
| SEQ ID | Structure<br>Peptide Sequence<br>Smiles |
| 309 | 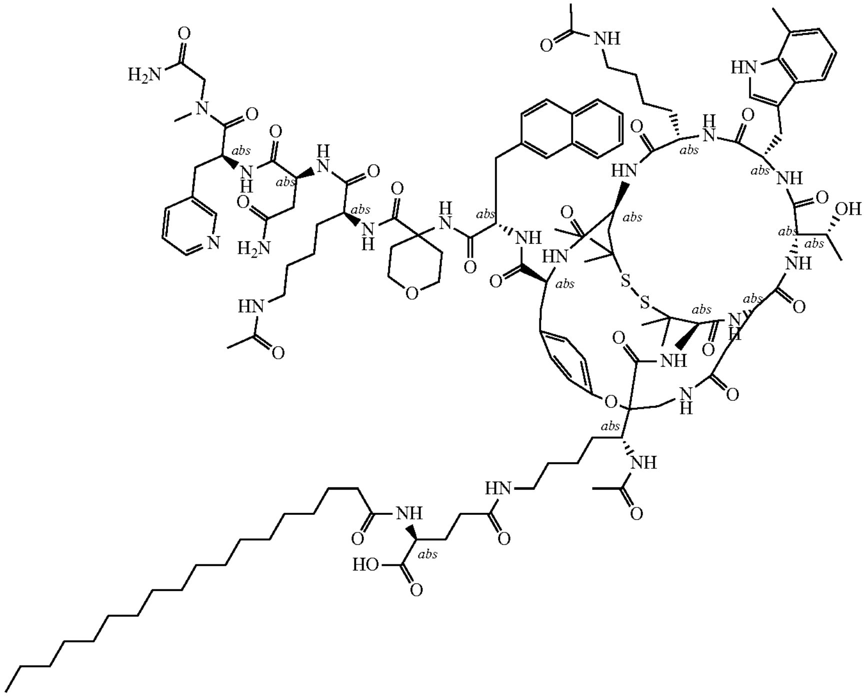<br>5Ava(2)-Abu(1)-K(PEG2PEG2gEC18OH)-T-W-Q-C(1)-AEF-2Nal-THP-E(2)-N-3Pya-Sar-CONH2<br>C[C@H]([C@@H](C(N[C@@H](Cc1c[nH]c2c1cccc2)C(N[C@@H](CCC(N)=O)C(N[C@@H](CSCC[C@@H](C(N[C@H]1CCCCNC(COCCOCCNC(COCCOCCNC(CC[C@@H](C(O)=O)NC(CCCCCCCCCCCCCCCCCC(O)=O)=O)=O)=O)=O)=O)NC(CCCCNC(CC[C@@H](C(N[C@@H](CC(N)=O)C(N[C@@H](Cc2cnccc2)(C(N(C)CC(N)=O)=O)=O)=O)NC(C2(CCOCC2)NC([C@H](Cc2cc3ccccc3cc2)NC[C@H](Cc(cc2)ccc2OCCN)N2)=O)=O)=O)=O)=O)C2=O)=O)=O)=O)NC1=O)O |

TABLE 1M-continued
| Compounds. | |
| --- | --- |
| SEQ ID | Structure<br>Peptide Sequence<br>Smiles |
| 310 | 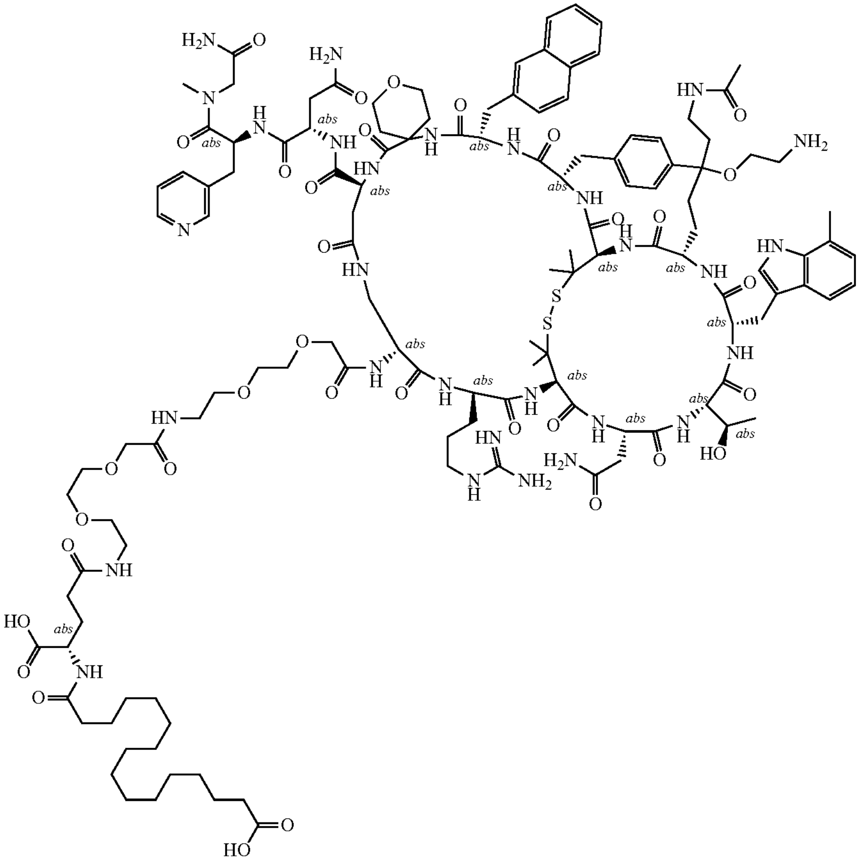 [SMILES: CC(=O)NCCC1(OCCN)CC[C@@H]2NC(=O)[C@H](Cc3c[nH]c4c(C)cccc34)NC(=O)[C@H]([C@@H](C)O)NC(=O)[C@H](CC(N)=O)NC(=O)[C@H]3NC(=O)[C@@H](CCCNC(=N)N)NC(=O)[C@H](NC(=O)COCCOCCNC(=O)COCCOCCNC(=O)CC[C@H](NC(=O)CCCCCCCCCCCCCCC(=O)O)C(=O)O)CCNC(=O)C[C@@H](C(=O)N[C@@H](CC(N)=O)C(=O)N[C@@H](Cc4cccnc4)C(=O)N(C)CC(N)=O)NC(=O)C4(CCOCC4)NC(=O)[C@H](Cc4ccc5ccccc5c4)NC(=O)[C@H](Cc4ccc1cc4)NC(=O)[C@@H](NC2=O)C(C)(C)SSC3(C)C]<br>MeCO-k(gEC18)-Pen(3)-E(2)-T-7MeW-K(Ac)-Pen(3)-AEF(2)-2Nal-THP-K(Ac)-N-3Pya-Sar-CONH2<br>CCCCCCCCCCCCCCCCCC(N[C@@H](CCC(NCCCC[C@H](C(N[C@@H](C(C)(C)SSC(C)(C)[C@@H](C(N[C@@H](Cc(cc1)ccc1OCCNC(CC[C@@H](C(N[C@@H]([C@@H](C)O)C(N[C@@H](Cc1c[nH]c2c1cccc2C)C(N[C@H]1CCCCNC(C)=O)=O)=O)=O)N2)=O)C(N[C@@H](Cc3cc4ccccc4cc3)C(NC3(CCOCC3)C(N |

TABLE 1M-continued
| Compounds. | |
|---|---|
| SEQ ID | Structure<br>Peptide Sequence<br>Smiles |
| 311 | [C@@H](CCCCNC(C)=O)C(N[C@@H](CC(N)=O)C(N[C@@H](Cc3cnccc3)C(N(C)CC(N)=O)=O)=O)=O)=O)=O)=O)=O)=O)NC1=O)C2=O)=O)NC(C)=O)=O)C(O)=O)=O<br>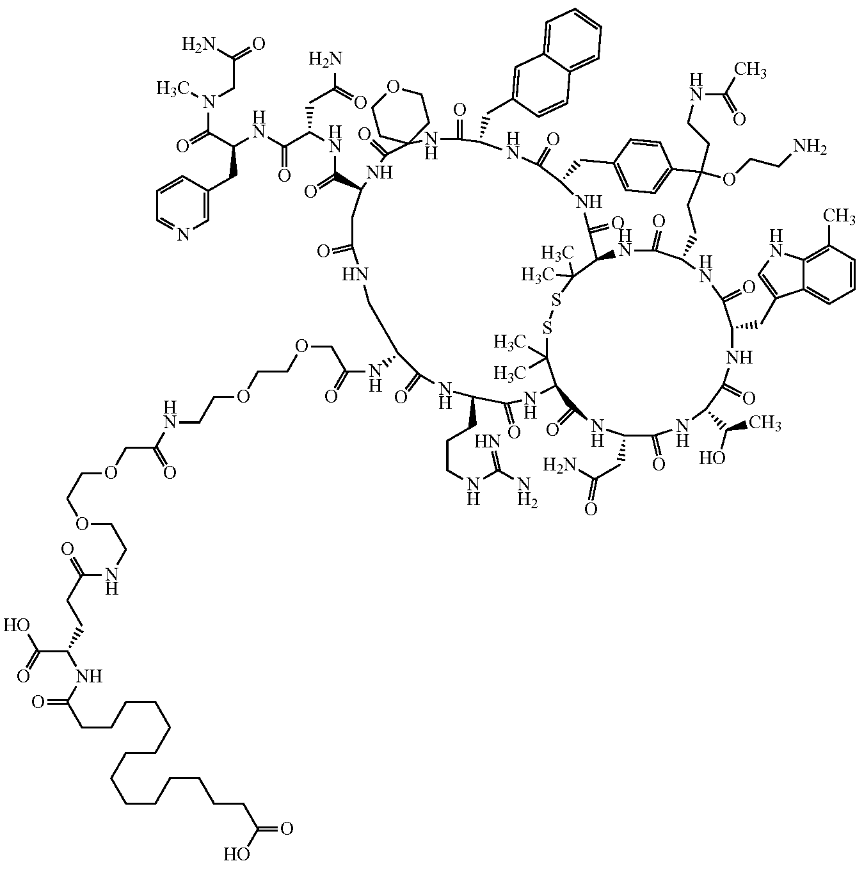 [SMILES: CC(=O)NCCC1(OCCN)CC[C@@H]2NC(=O)[C@H](Cc3c[nH]c4c(C)cccc34)NC(=O)[C@H]([C@@H](C)O)NC(=O)[C@H](CC(N)=O)NC(=O)[C@H]3NC(=O)[C@@H](CCCNC(=N)N)NC(=O)[C@H](NC(=O)COCCOCCNC(=O)COCCOCCNC(=O)CC[C@H](NC(=O)CCCCCCCCCCCCCCC(=O)O)C(=O)O)CCNC(=O)C[C@@H](C(=O)N[C@@H](CC(N)=O)C(=O)N[C@@H](Cc4cccnc4)C(=O)N(C)CC(N)=O)NC(=O)C4(CCOCC4)NC(=O)[C@H](Cc4ccc5ccccc5c4)NC(=O)[C@H](Cc4ccc1cc4)NC(=O)[C@@H](NC2=O)C(C)(C)SSC3(C)C]<br>HOC16gEPEG2PEG2orn(2)-r-Pen(3)-N-T-7MeW-K(Ac)-Pen(3)-AEF-2Nal-THP-E(2)-N-3Pya-Sar-CONH2 |

TABLE 1M-continued

Compounds.

| SEQ ID | Structure<br>Peptide Sequence<br>Smiles |
|---|---|
| | C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC([C@@H](CCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)NC(COCCOCCNC(COCCOCCNC(CC[C@@H](C(O)=O)NC(CCCCCCCCCCCCCCCC(O)=O)=O)=O)=O)=O)=O)=O)C2=O)=O)=O)=O)NC1=O)O |
| 312 | 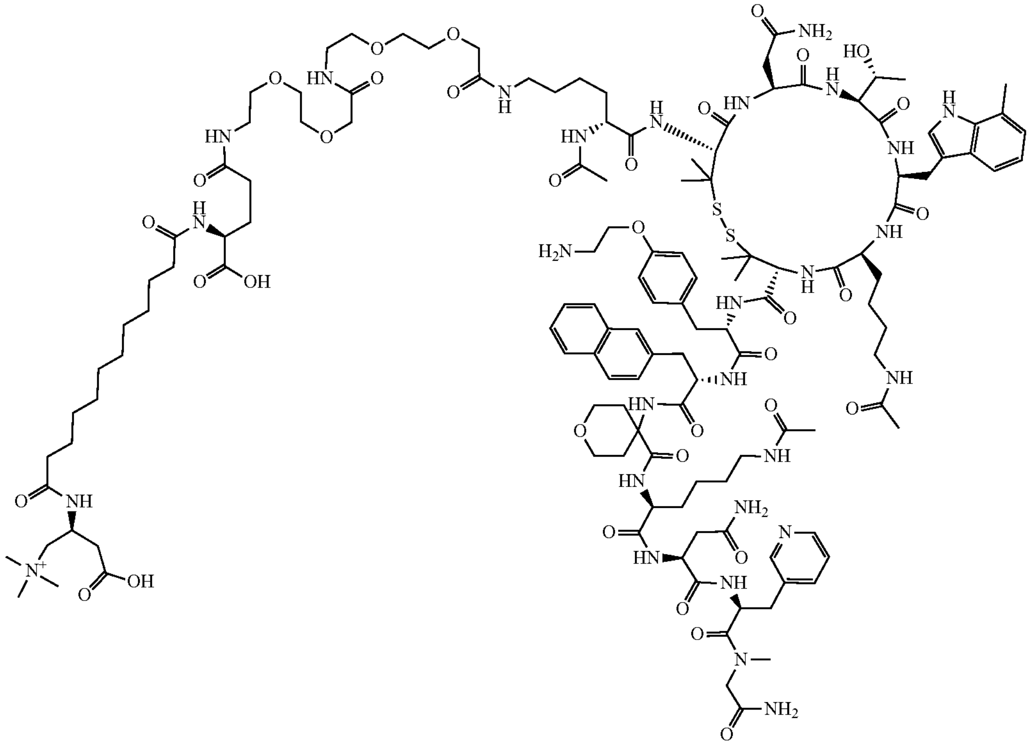 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)COCCOCCNC(=O)COCCOCCNC(=O)CC[C@H](NC(=O)CCCCCCCCCCC(=O)N[C@@H](CC(=O)O)C[N+](C)(C)C)C(=O)O)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC1=O]<br>CF3CO-k(PEG2PEG2gEC18OH)-Pen(3)-E(2)-T-7MeW-K(Me)3-Pen(3)-AEF(2)-2Nal-THP-K(Me)3-N-3Pya-Sar-CON(Me)2<br>C[C@H]([C@@H](C(N[C@@H](Cc1c[nH]c2c1cccc2C)C(N[C@@H](CCCC[N+] |

TABLE 1M-continued
| SEQ ID | Compounds. Structure Peptide Sequence Smiles |
|---|---|
| 313 | (C)(C)C)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCCC[N+](C)(C)C)C(N[C@@H](CC(N)=O)C(N[C@@H](Cc3cnccc3)C(N(C)CC(N(C)C)=O)=O)=O)=O)=O)=O)=O)N3)cc2)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)NC(C(F)(F)F)=O)=O)C3=O)=O)=O)=O)NC1=O)O<br>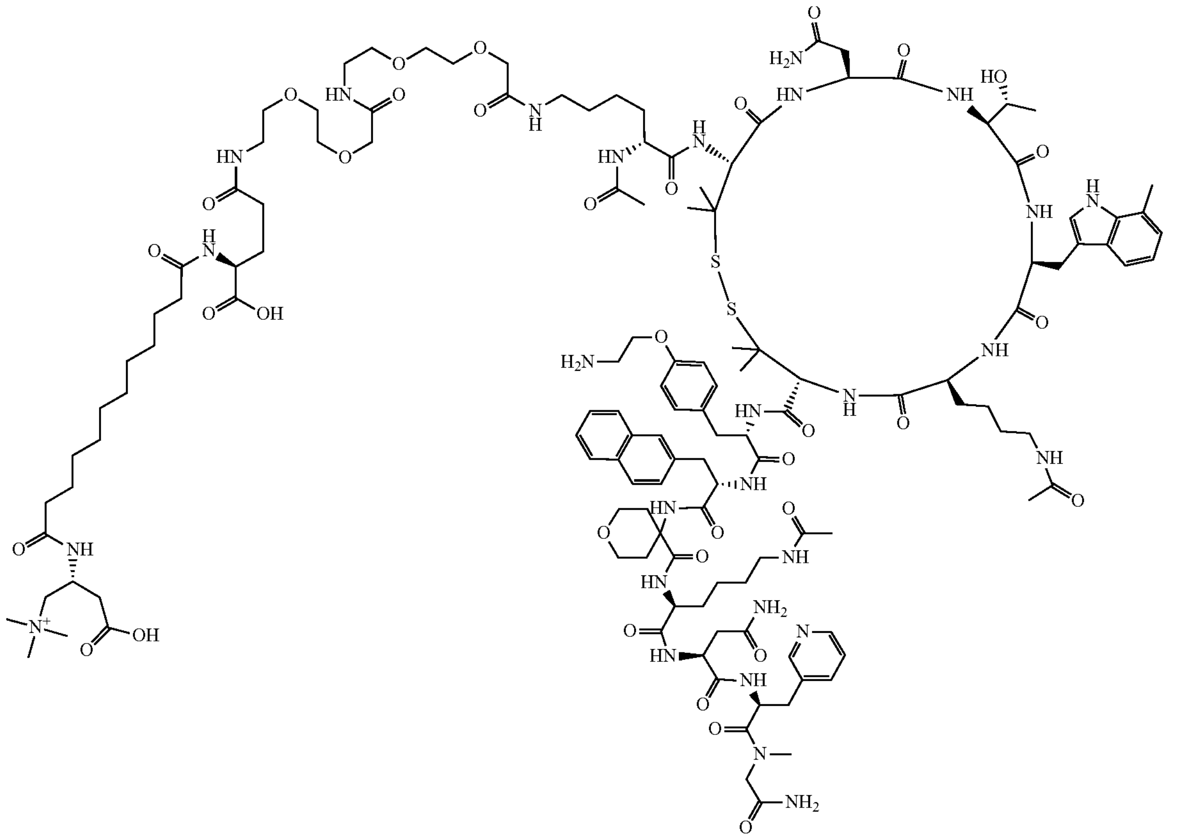 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)COCCOCCNC(=O)COCCOCCNC(=O)CC[C@H](NC(=O)CCCCCCCCCCC(=O)N[C@H](CC(=O)O)C[N+](C)(C)C)C(=O)O)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC1=O] |

TABLE 1M-continued

| SEQ ID | Compounds. Structure Peptide Sequence Smiles |
|---|---|
| 314 | MeCO-k(PEG2PEG2gEC12OH(C))-Pen(3)-N-T-7MeW-K(Ac)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCCCC(N[C@@H](CC(O)=O)C[N+](C)(C)C)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O<br>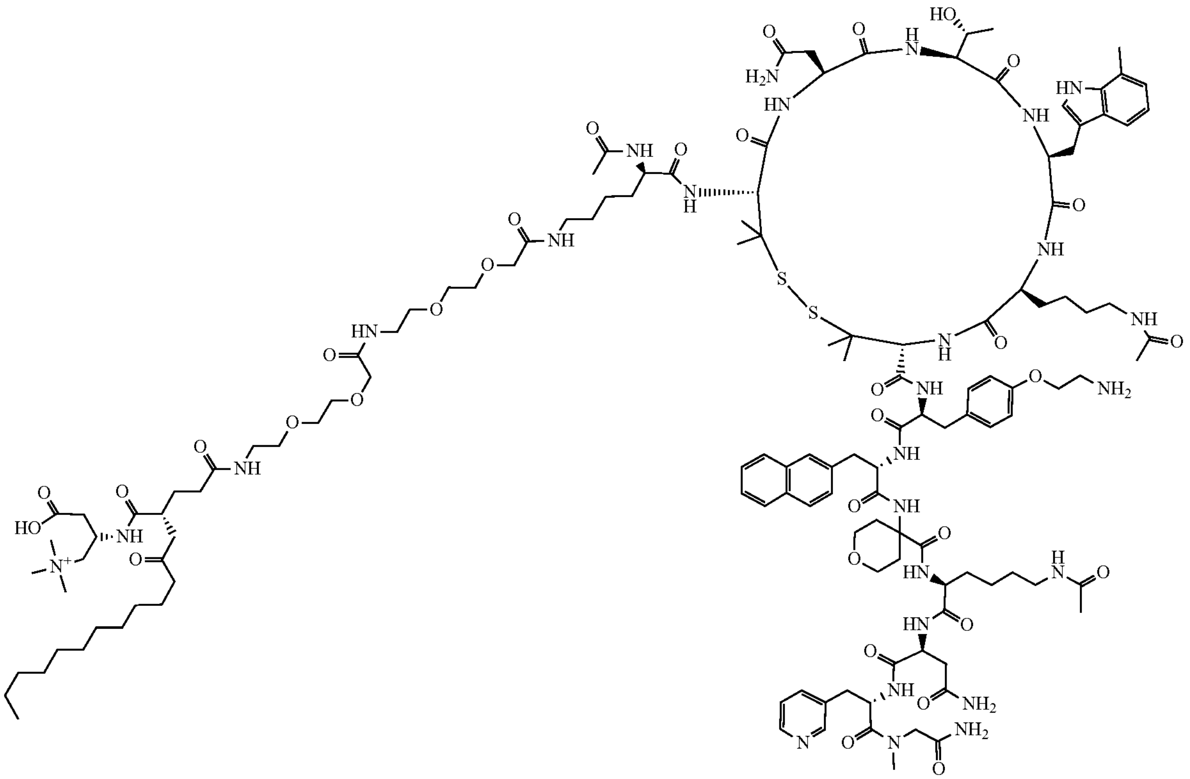 |

TABLE 1M-continued

| SEQ ID | Compounds.<br>Structure<br>Peptide Sequence<br>Smiles |
|---|---|
| | MeCO-k(PEG2PEG2gEC12OH(c))-Pen(3)-N-T-7MeW-K(Ac)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCCCC(N[C@H](CC(O)=O)C[N+](C)(C)C)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)NC1=O)O |
| 315 | 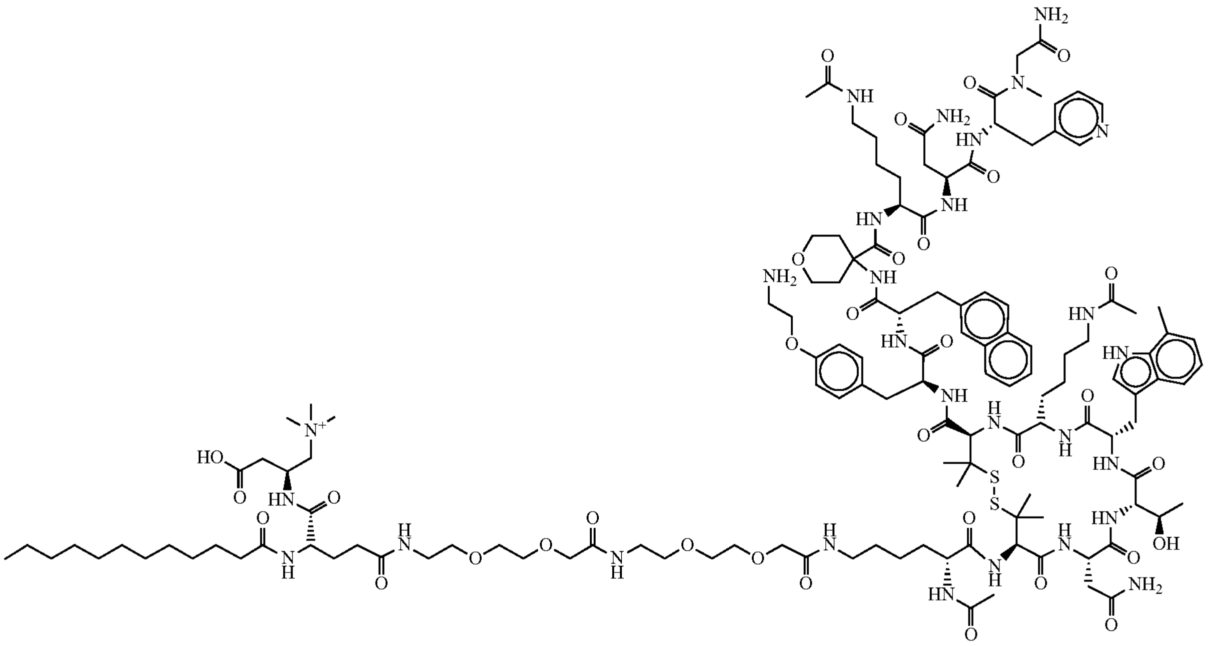<br>MeCO-k(PEG2PEG2gE(C)C12)-Pen(3)-N-T-7MeW-K(Ac)-Pen(3)-AEF-2Nal-THP-K(Ac)-N-3Pya-Sar-CONH2<br>CCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCCCNC(C)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(C)=O)=O)=O)=O)C(N[C@@H](CC(O)=O)C[N+](C)(C)C)=O)=O |

TABLE 1M-continued
| Compounds. | |
|---|---|
| SEQ ID | Structure<br>Peptide Sequence<br>Smiles |
| 316 | 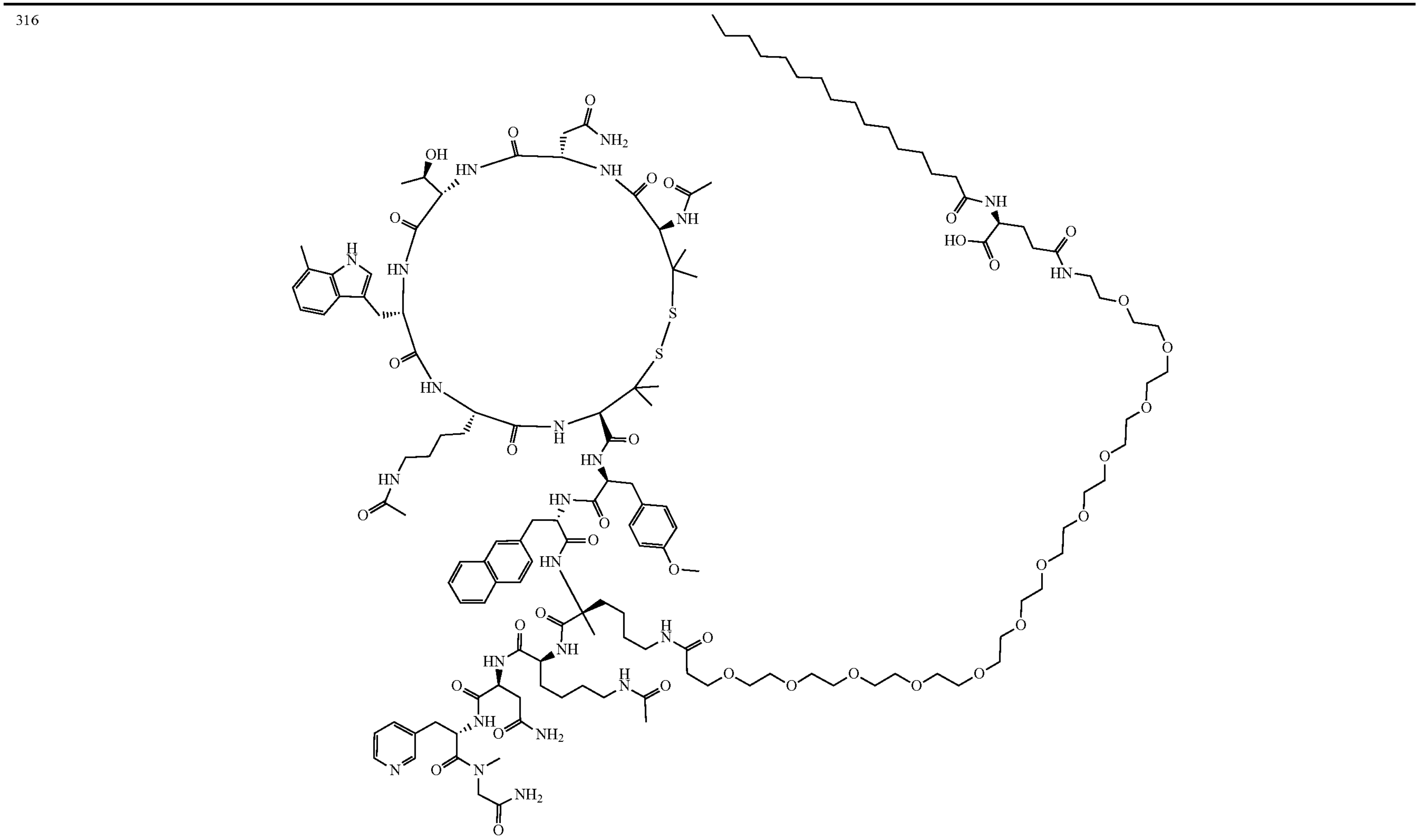 |

TABLE 1M-continued

| Compounds. | |
|---|---|
| SEQ ID | Structure<br>Peptide Sequence<br>Smiles |
| 317 | MeCO-Pen(3)-N-T-7MeW-K(Ac)-Pen(3)-4AmF-2Nal-aMeK(PEG12gEC16)-K(Ac)-N-3Pya-Sar-CONH2<br>CCCCCCCCCCCCCCCC(N[C@@H](CCC(NCCOCCOCCOCCOCCOCCOCCOCCOCCOCCOCCOCCOCCC(NCCCC[C@@](C)(C(N[C@@H](CCCCNC(C)=O)C(N[C@@H](CC(N)=O)C(N[C@@H](Cc1cnccc1)C(N(C)CC(N)=O)=O)=O)=O)=O)NC([C@H](Cc1cc2ccccc2cc1)NC([C@H](Cc(cc1)ccc1C(N)=O)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)C(O)=O)=O<br>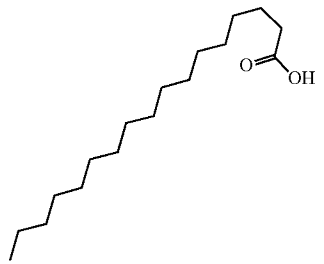 |

TABLE 1M-continued
| Compounds. | |
| --- | --- |
| SEQ ID | Structure<br>Peptide Sequence<br>Smiles |
| | 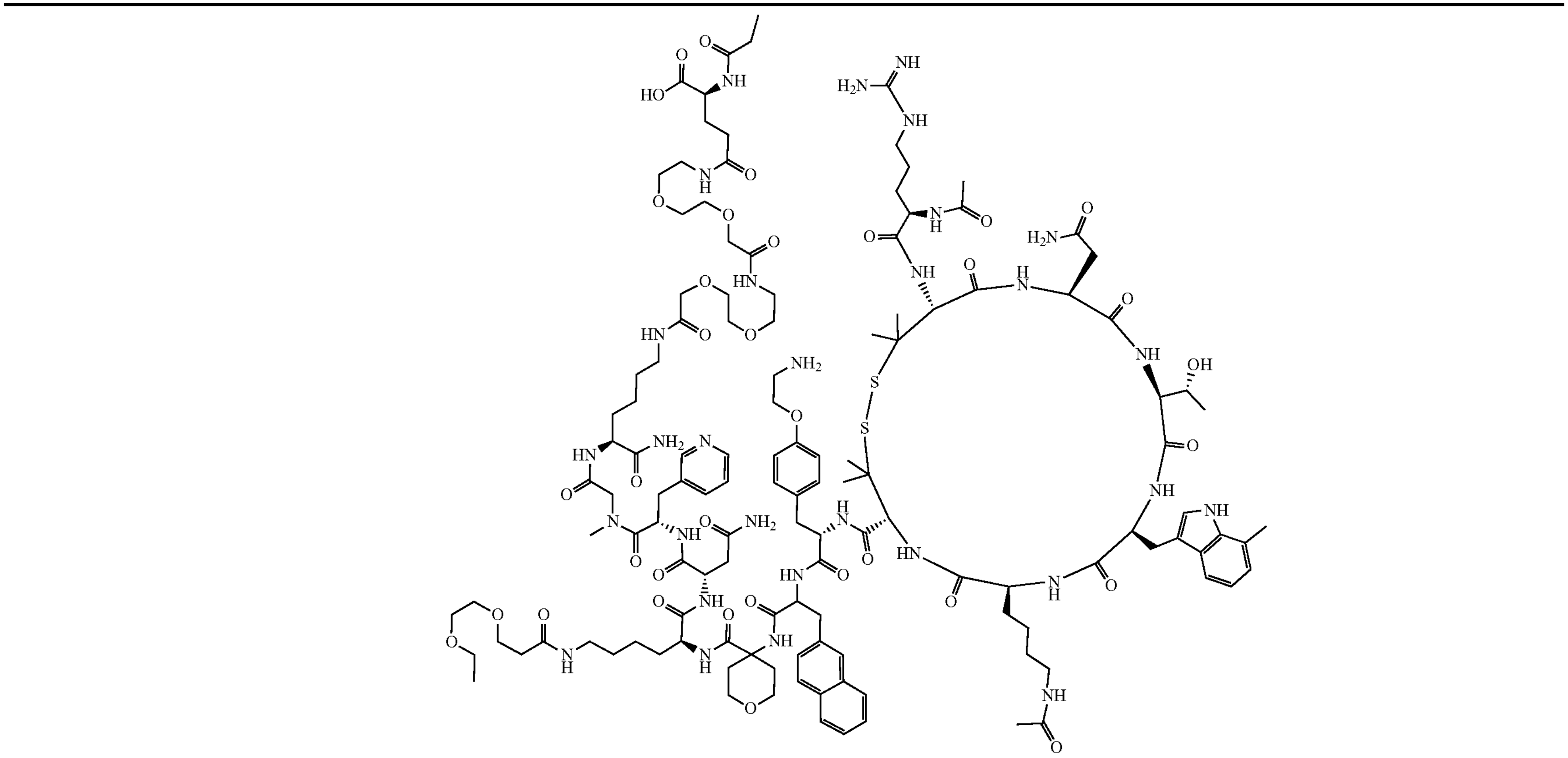 |

TABLE 1M-continued

| Compounds. | |
|---|---|
| SEQ ID | Structure<br>Peptide Sequence<br>Smiles |
| | 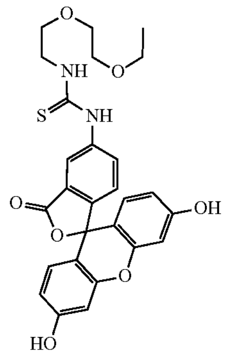<br>MeCO-Pen(3)-N-T-7MeW-K(Ac)-Pen(3)-40MeF-2Nal-aMeK(PEG12gEC16)-K(Ac)-N-3Pya-Sar-CONH2<br>CCCCCCCCCCCCCCCC(N[C@@H](CCC(NCCOCCOCCOCCOCCOCCOCCOCCOCCOCCOCCOCCOCCC(NCCCC[C@@](C)(C(N[C@@H](CCCCNC(C)=O)C(N[C@@H](CC(N)=O)C(N[C@@H](Cc1cnccc1)C(N(C)CC(N)=O)=O)=O)=O)=O)=O)NC([C@H](Cc1cc2ccccc2cc1)NC([C@H](Cc(cc1)ccc1OC)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)C(O)=O)=O)=O |

TABLE 1M-continued

| SEQ ID | Compounds. Structure Peptide Sequence Smiles |
|---|---|
| 318 | 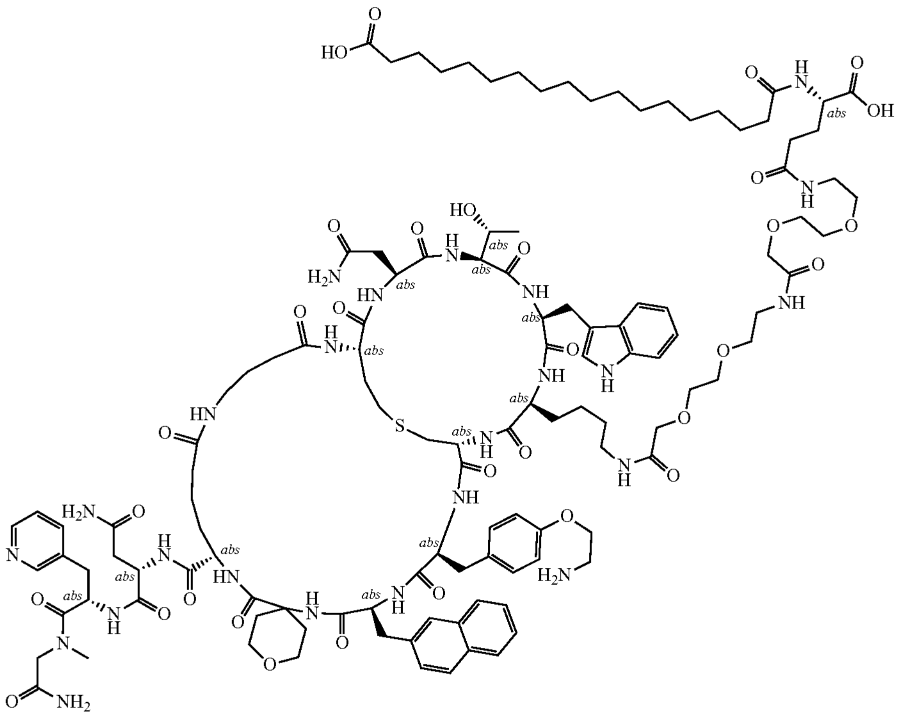 [SMILES: C[C@@H](O)[C@@H]1NC(=O)[C@H](CC(N)=O)NC(=O)[C@@H]2CCSC[C@H](NC(=O)[C@H](CCCCNC(=O)COCCOCCNC(=O)COCCOCCNC(=O)CC[C@H](NC(=O)CCCCCCCCCCCCCCCCC(=O)O)C(=O)O)NC(=O)[C@H](Cc3c[nH]c4ccccc34)NC1=O)C(=O)N[C@@H](Cc1ccc(OCCN)cc1)C(=O)N[C@@H](Cc1ccc3ccccc3c1)C(=O)NC1(CCOCC1)C(=O)N[C@H](C(=O)N[C@@H](CC(N)=O)C(=O)N[C@@H](Cc1cccnc1)C(=O)N(C)CC(N)=O)CCCC(=O)NCCCC(=O)N2]<br>MeCO-r-Pen(3)-N-T-7MeW-K(Ac)-Pen(3)-AEF-2Nal-THP-K(FITCPEG4)-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(CCOCCOCCOCCOCCNC(Nc2cc(C(OC34c(ccc(O)c5)c5Oc5c3ccc(O)c5)=O)c4cc2)=S)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 319 | 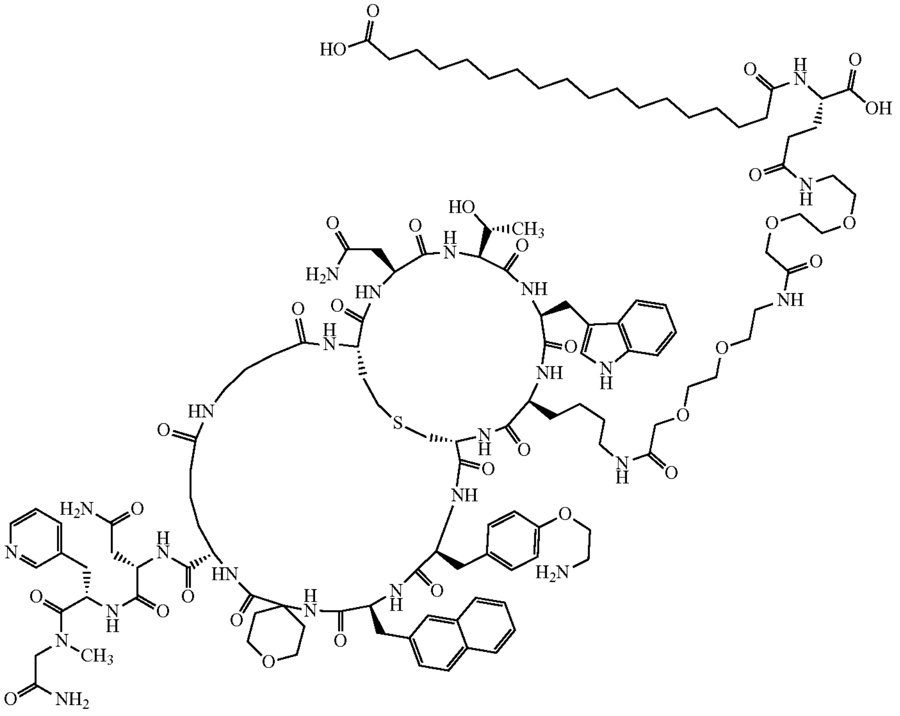 [SMILES: C[C@@H](O)[C@@H]1NC(=O)[C@H](CC(N)=O)NC(=O)[C@@H]2CCSC[C@H](NC(=O)[C@H](CCCCNC(=O)COCCOCCNC(=O)COCCOCCNC(=O)CC[C@H](NC(=O)CCCCCCCCCCCCCCCCC(=O)O)C(=O)O)NC(=O)[C@H](Cc3c[nH]c4ccccc34)NC1=O)C(=O)N[C@@H](Cc1ccc(OCCN)cc1)C(=O)N[C@@H](Cc1ccc3ccccc3c1)C(=O)NC1(CCOCC1)C(=O)N[C@H](C(=O)N[C@@H](CC(N)=O)C(=O)N[C@@H](Cc1cccnc1)C(=O)N(C)CC(N)=O)CCCC(=O)NCCCC(=O)N2]<br>5Ava(2)-Abu(1)-N-T-W-K(PEG2PEG2gEC18OH)-C(1)-AEF-2Nal-THP-E(2)-N-3Pya-Sar-CONH2<br>C[C@H]([C@@H](C(N[C@@H](Cc1c[nH]c2c1cccc2)C(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N[C@@H](CSCC[C@@H](C(N[C@H]1CC(N)=O)=O)NC(CCCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued

| Compounds. | |
|---|---|
| SEQ ID | Structure<br>Peptide Sequence<br>Smiles |
| 320 | 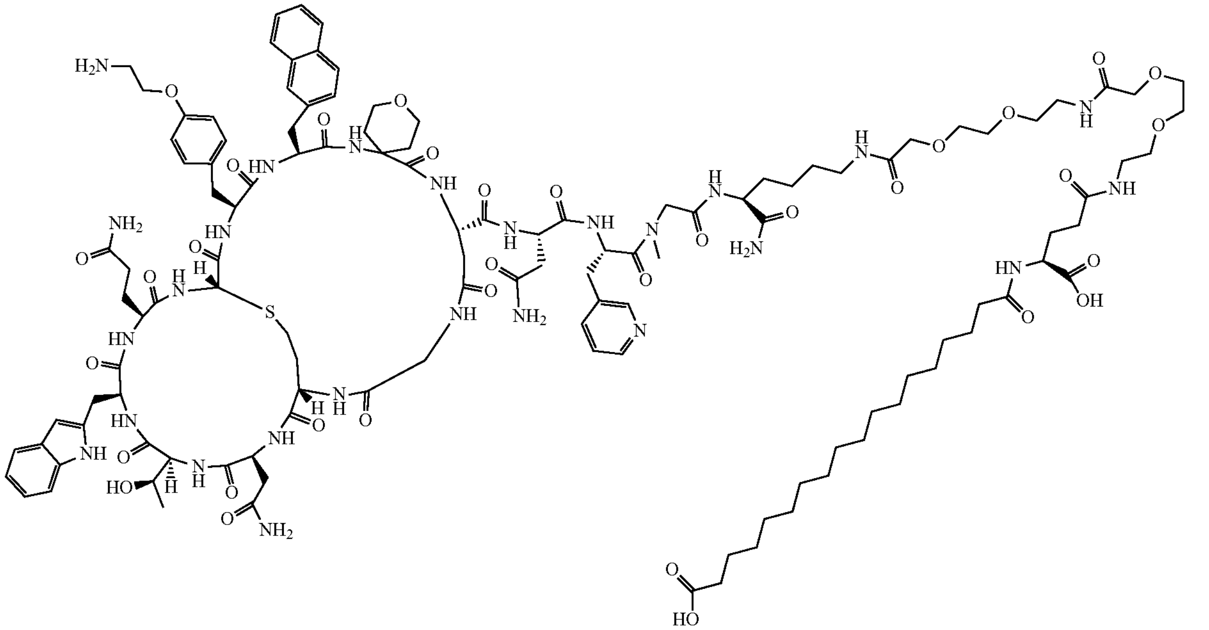 [SMILES: C[C@@H](O)[C@@H]1NC(=O)[C@H](CC(N)=O)NC(=O)[C@@H]2CCS[C@H](NC(=O)[C@H](CCC(N)=O)NC(=O)[C@H](Cc3cc4ccccc4[nH]3)NC1=O)C(=O)N[C@@H](Cc1ccc(OCCN)cc1)C(=O)N[C@@H](Cc1ccc3ccccc3c1)C(=O)NC1(CCOCC1)C(=O)N[C@H](C(=O)N[C@@H](CC(N)=O)C(=O)N[C@@H](Cc1cccnc1)C(=O)N(C)CC(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(N)=O)CC(=O)NCC(=O)N2]<br>5Ava(2)-Abu(1)-N-T-W-Q-C(1)-AEF-2Nal-THP-E(2)-N-3Pya-Sar-K(PEG2PEG2gEC18OH)-CONH2<br>C[C@H]([C@@H](C(N[C@@H](Cc1c[nH]c2c1cccc2)C(N[C@@H](CCC(N)=O)C(N[C@@H](CSCC[C@@H](C(N[C@H]1CC(N)=O)=O)NC(CCCCNC(CC[C@@H](C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued
Compounds.
| SEQ ID | Structure<br>Peptide Sequence<br>Smiles |
|---|---|
| 321 | 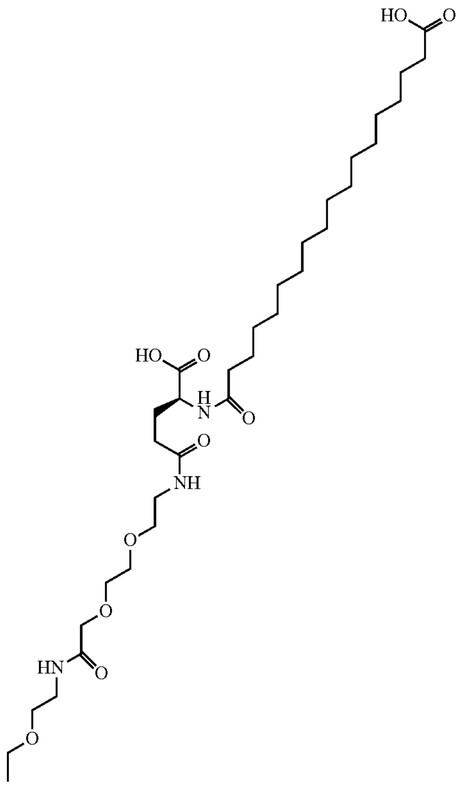 |

TABLE 1M-continued

| Compounds. | |
|---|---|
| SEQ ID | Structure<br>Peptide Sequence<br>Smiles |
| | 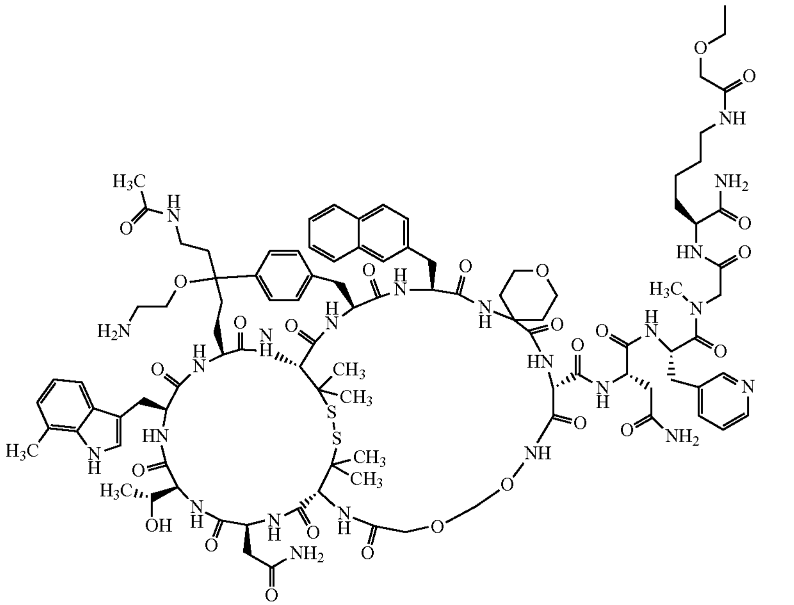<br>AEEP(2)-Pen(3)-N-T-7MeW-K(Ac)-Pen(3)-AEF-2Nal-THP-E(2)-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(CCOCCOCCNC(CC[C@@H](C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued
| Compounds. | |
|---|---|
| SEQ ID | Structure<br>Peptide Sequence<br>Smiles |
| 322 | 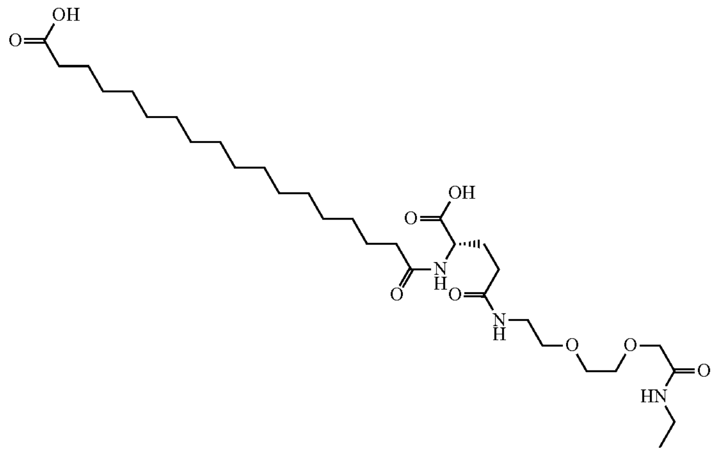 |

TABLE 1M-continued

| Compounds. | |
|---|---|
| SEQ ID | Structure<br>Peptide Sequence<br>Smiles |
| | 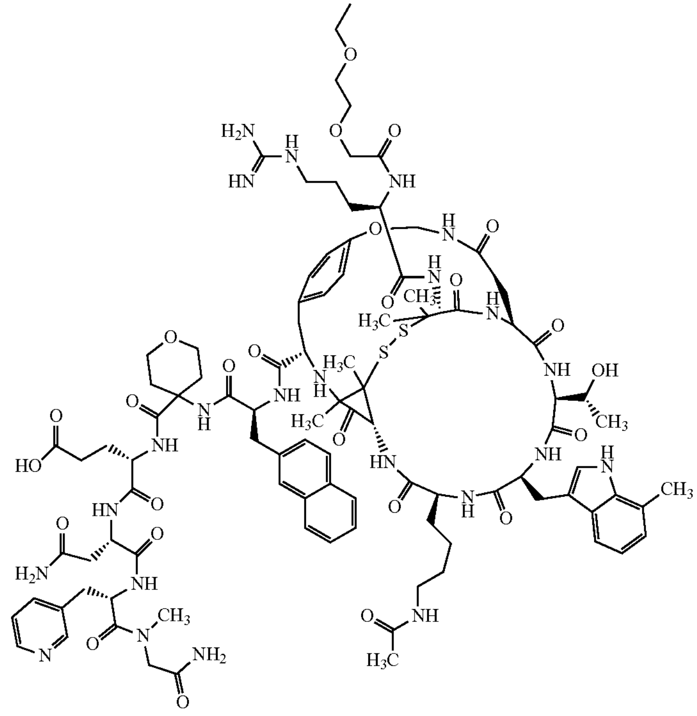<br>HOC18gEPEG2PEG2CO-r-Pen(3)-E(2)-T-7MeW-K(Ac)-Pen(3)-AEF(2)-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCC(O)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCNC(N)=N)NC(COCCOCCNC(COCCOCCNC(CC[C@@H](C(O)=O)NC(CCCCCCCCCCCCCCCCC(O)=O)=O)=O)=O)=O)=O)C3=O)=O)=O)=O)NC1=O)O |

TABLE 1M-continued
| Compounds. | |
|---|---|
| SEQ ID | Structure<br>Peptide Sequence<br>Smiles |
| 323 | 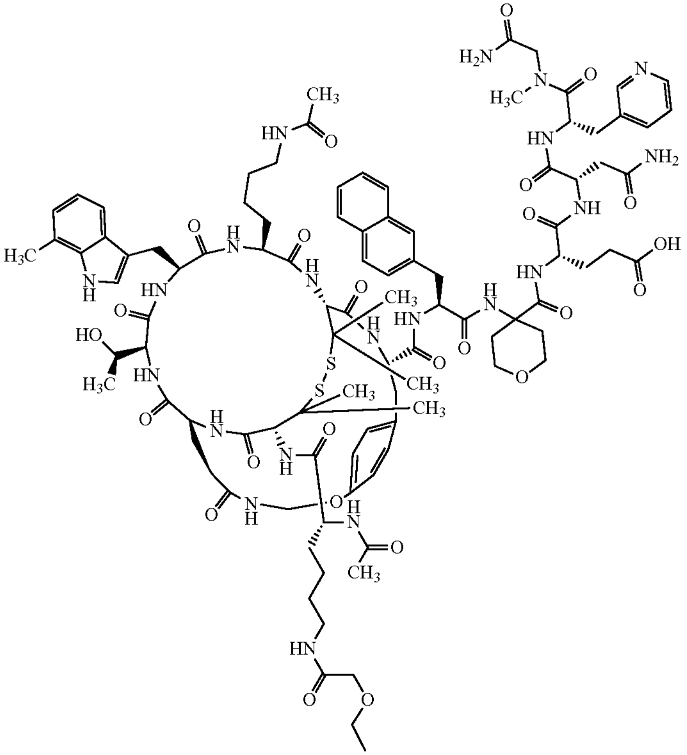 |

TABLE 1M-continued
| Compounds. | |
|---|---|
| SEQ ID | Structure<br>Peptide Sequence<br>Smiles |
| | 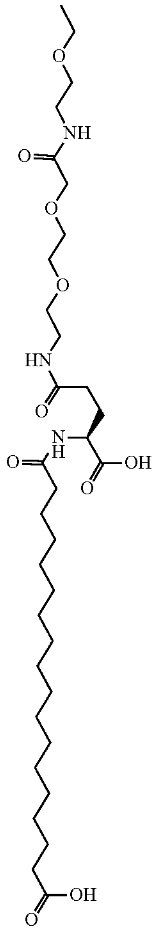<br>MeCO-k(PEG2PEG2gEC18OH)-Pen(3)-E(2)-T-7MeW-K(Ac)-Pen(3)-AEF(2)-2Nal-THP-E-N-3Pya-Sar-CONH2<br>C[C@H]([C@@H](C(N[C@@H](Cc1c[nH]c2c1cccc2C)C(N[C@@H](CCCCNC |

TABLE 1M-continued
| Compounds. | |
|---|---|
| SEQ ID | Structure<br>Peptide Sequence<br>Smiles |
| | (C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCC(O)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)NC(C)=O)=O)C3=O)=O)=O)=O)NC1=O)O |
| 324 | 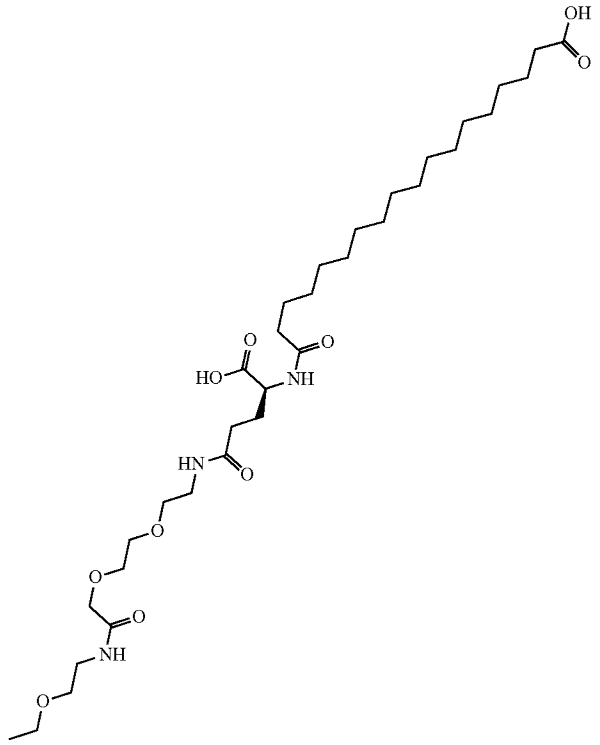 |

TABLE 1M-continued

Compounds.

| SEQ ID | Structure<br>Peptide Sequence<br>Smiles |
|---|---|
| | 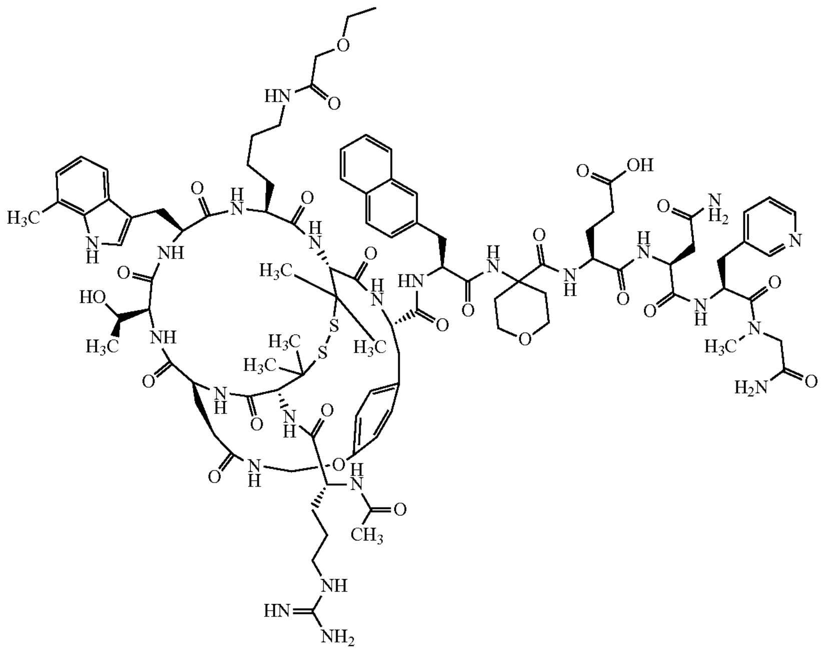<br>MeCO-r-Pen(3)-E(2)-T-7MeW-K(PEG2PEG2gEC18OH)-Pen(3)-AEF(2)-2Nal-THP-E-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCC(O)=O)C(N[C@@H](CC(N)=O)C(N[C@@H](Cc3cnccc3)C(N(C)CC(N)=O)=O)=O)=O)=O)=O)=O)N3)cc2)=O)=O)NC([C@@H](CCCNC(N)=N)NC(C)=O)=O)C3=O)=O)=O)=O)NC1=O)O |

TABLE 1M-continued
| Compounds. | |
|---|---|
| SEQ ID | Structure<br>Peptide Sequence<br>Smiles |
| 325 | 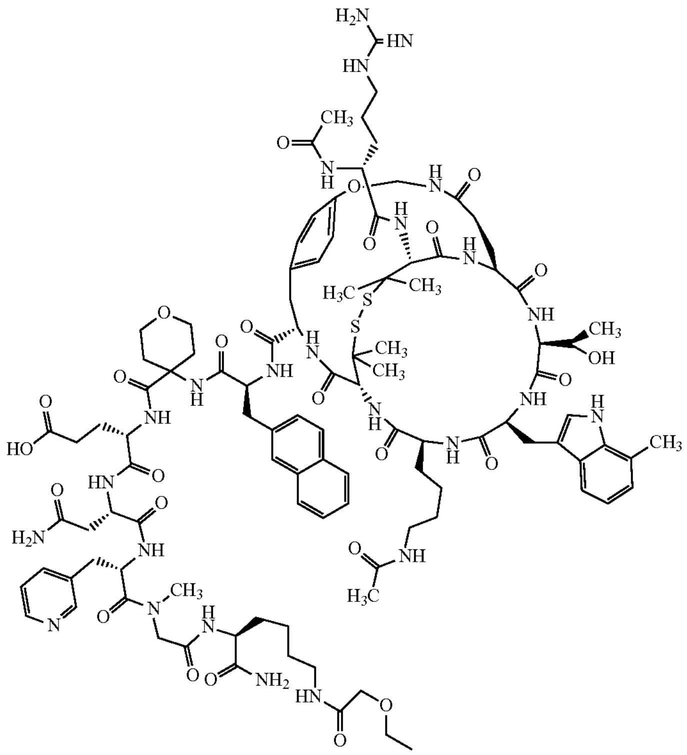 |

TABLE 1M-continued

| Compounds. | |
|---|---|
| SEQ ID | Structure<br>Peptide Sequence<br>Smiles |
| | 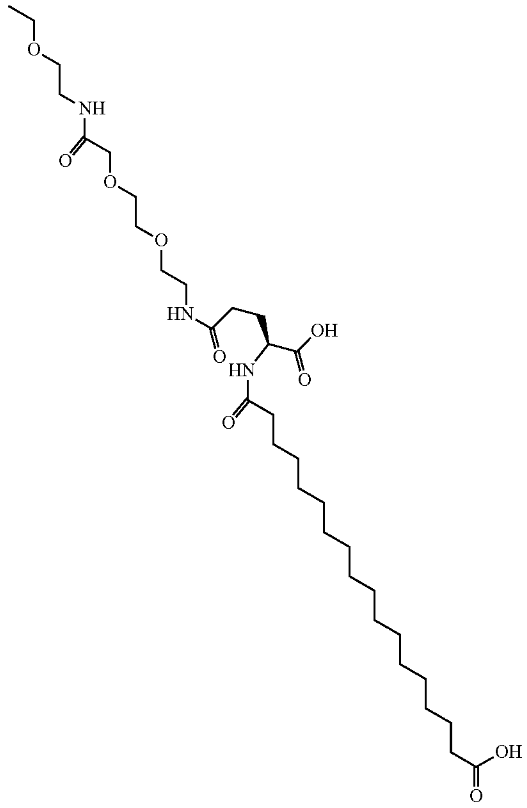<br>MeCO-r-Pen(3)-E(2)-T-7MeW-K(Ac)-Pen(3)-AEF(2)-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCC(NCCOc2ccc(C[C@@H](C(N[C@@H](Cc3cc4ccccc4cc3)C(NC3(CCOCC3)C(N[C@@H](CCC(O)=O)C(N[C@@H](CC(N)=O)C(N[C@@H](Cc3cnccc3)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)N3)cc2)=O)=O)NC([C@@H](CCCNC(N)=N)NC(C)=O)=O)C3=O)=O)=O)=O)NC1=O)O |

TABLE 1M-continued
| Compounds. | |
|---|---|
| SEQ ID | Structure<br>Peptide Sequence<br>Smiles |
| 326 | 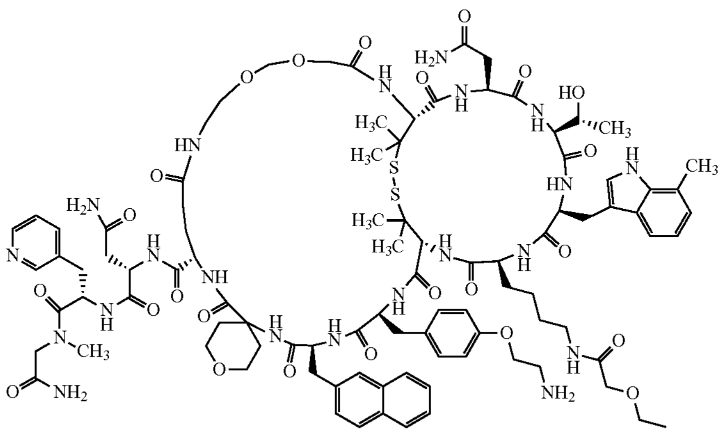 |

TABLE 1M-continued

| Compounds. | |
|---|---|
| SEQ ID | Structure<br>Peptide Sequence<br>Smiles |
| | 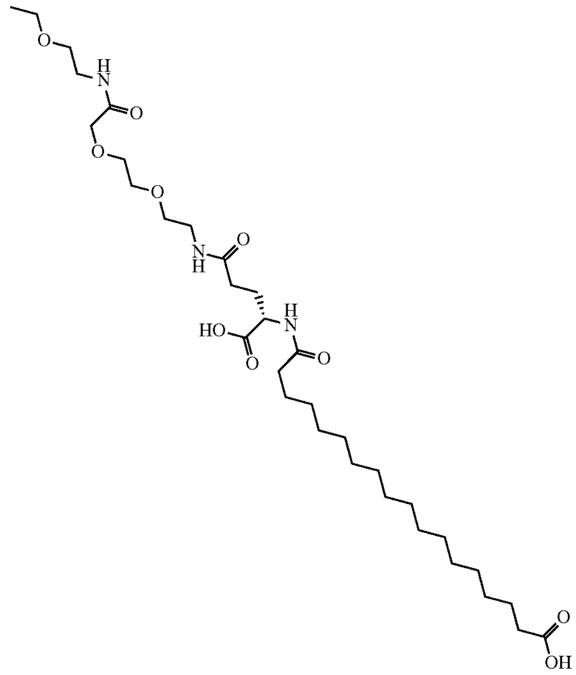<br>AEEP(2)-Pen(3)-N-T-7MeW-K(PEG2PEG2gEC18OH)-Pen(3)-AEF-2Nal-THP-E(2)-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](C(C)(C)SSC(C)(C)[C@@H](C(N[C@H]1CC(N)=O)=O)NC(CCOCCOCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2cc3ccccc3cc2)NC([C@H](Cc(cc2)ccc2OCCN)N2)=O)=O)=O)=O)=O)C2=O)=O)=O)=O)NC1=O)O |

TABLE 1M-continued
| Compounds. | |
|---|---|
| SEQ ID | Structure<br>Peptide Sequence<br>Smiles |
| 327 | 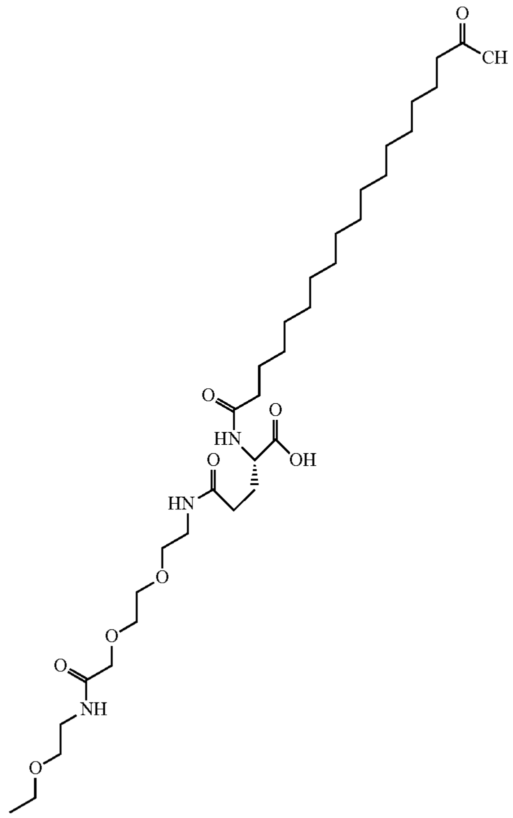 |

TABLE 1M-continued

| SEQ ID | Compounds. Structure Peptide Sequence Smiles |
| --- | --- |
| | 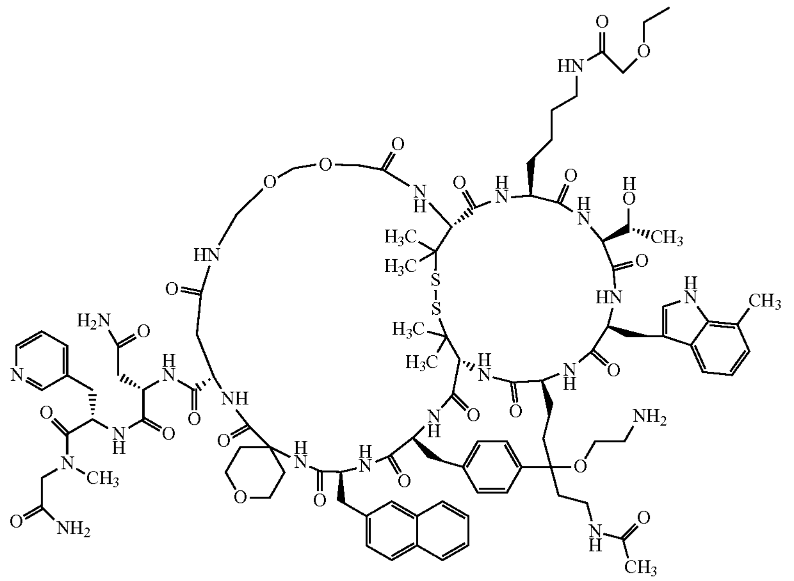 AEEP(2)-Pen(3)-K(PEG2PEG2gEC18OH)-T-7MeW-K(Ac)-Pen(3)-AEF-2Nal-THP-E(2)-N-3Pya-Sar-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC(CCOCCOCCNC(CC[C@@H](C(N[C@@H](CC(N)=O)C(N[C@@H](Cc2cnccc2)C(N(C)CC(N)=O)=O)=O)=O)NC(C2(CCOCC2)NC([C@H](Cc2ccc3ccccc3cc2)NC([C@H](Cc(cc2)ccc2OCCN)N2)=O)=O)=O)=O)=O)C2=O)=O)=O)=O)NC1=O)O |

TABLE 1M-continued

| Compounds. | |
|---|---|
| SEQ ID | Structure<br>Peptide Sequence<br>Smiles |
| 328 | 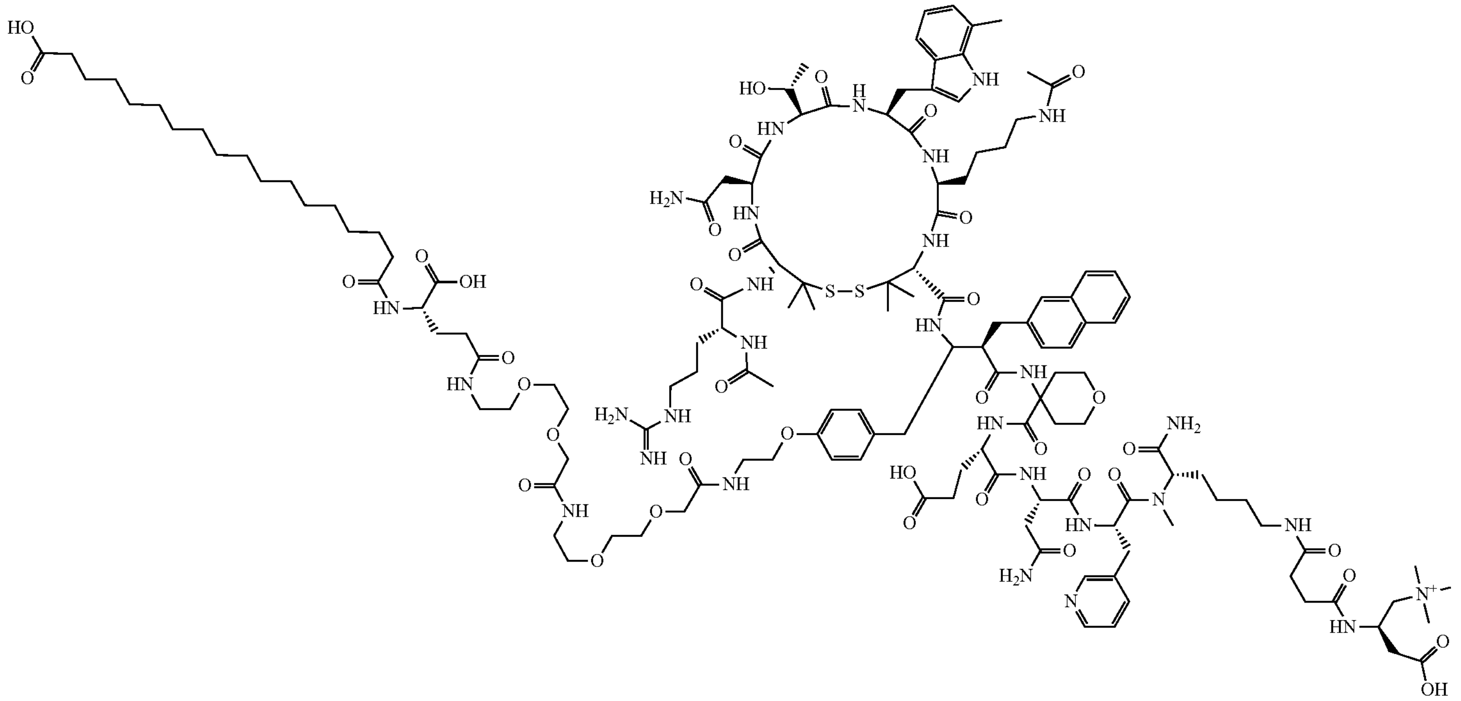 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(C)=O)C(C)(C)SSC(C)(C)[C@@H](C(=O)NC(Cc2ccc(OCCNC(=O)COCCOCCNC(=O)COCCOCCNC(=O)CC[C@H](NC(=O)CCCCCCCCCCCCCCCCC(=O)O)C(=O)O)cc2)[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)[C@@H](CCCCNC(=O)CCC(=O)N[C@H](CC(=O)O)C[N+](C)(C)C)C(N)=O)CCOCC2)NC1=O]<br>MeCO-r-Pen(3)-N-T-7MeW-K(Ac)-Pen(3)-AEF(PEG2PEG2gEC18OH)-2Nal-THP-E-N-3Pya-NMeK(d)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc2)ccc2OCCNC(COCCOCCNC(COCCOCCNC(CC[C@@H](C(O)=O)NC(CCCCCCCCCCCCCCCCC(O)=O)=O)=O)=O)=O)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)[C@@H](CCCCNC(CCC(N[C@H](CC(O)=O)C[N+](C)(C)C)=O)=O)C(N)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 329 | 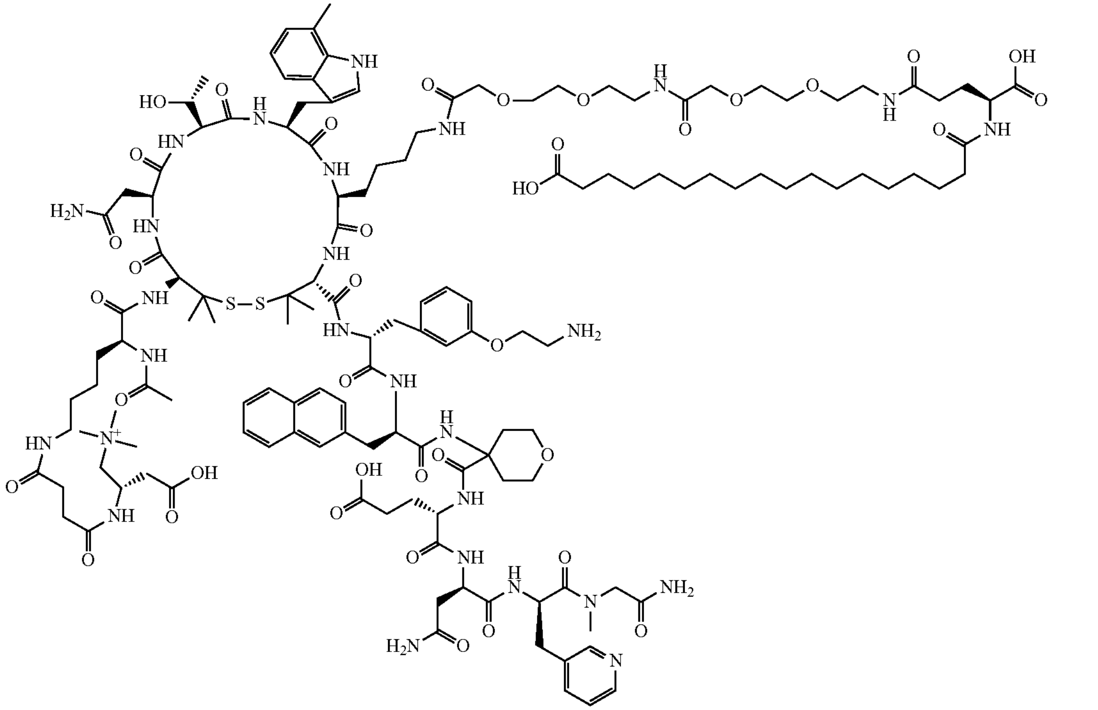 [SMILES: CC(=O)N[C@@H](CCCCNC(=O)CCC(=O)N[C@@H](CC(=O)O)C[N+](C)(C)C)C(=O)N[C@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(=O)N[C@H](C(=O)N[C@H](Cc2cccc(OCCN)c2)C(=O)N[C@H](Cc2ccc3ccccc3c2)C(=O)NC2(C(=O)N[C@@H](CCC(=O)O)C(=O)N[C@H](CC(N)=O)C(=O)N[C@H](Cc3cccnc3)C(=O)N(C)CC(N)=O)CCOCC2)C(C)(C)SSC1(C)C]<br>MeCO-k(d)-Pen(3)-N-T-7MeW-K(PEG2PEG2gEC18OH)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](C(C)(C)SSC(C)(C)[C@H](C(N[C@H]1CC(N)=O)=O)NC([C@@H](CCCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 330 | 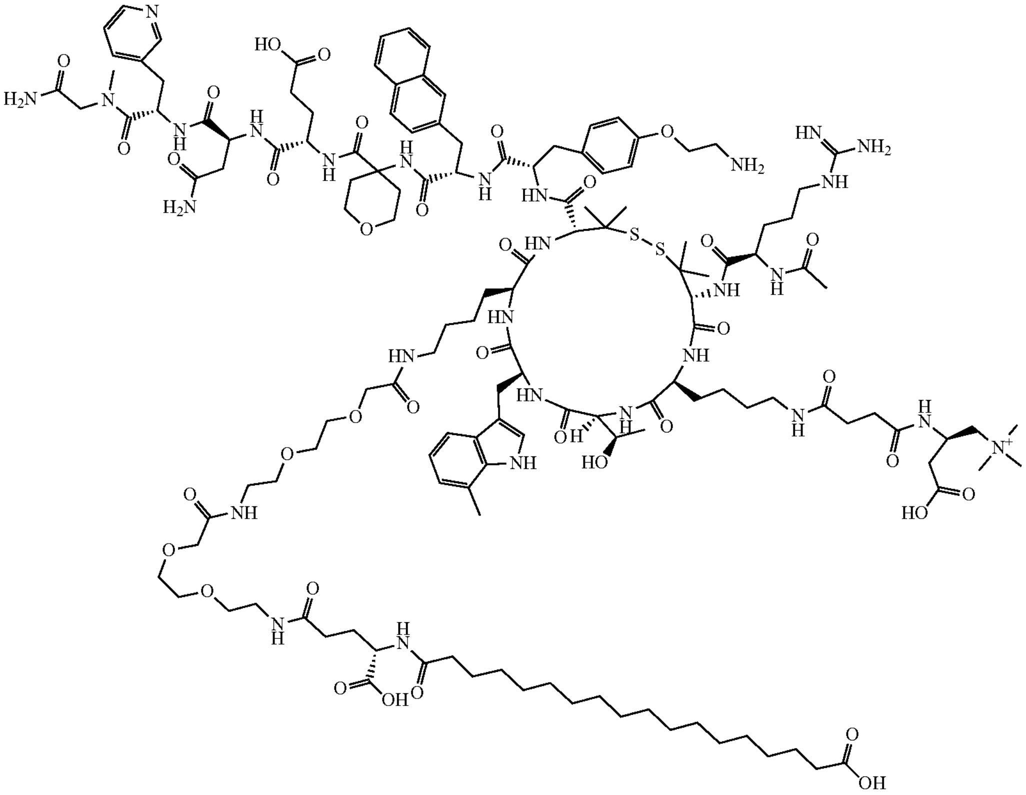 [SMILES: CC(=O)N[C@H](CCCNC(=N)N)C(=O)N[C@@H]1C(=O)N[C@@H](CCCCNC(=O)CCC(=O)N[C@H](CC(=O)O)C[N+](C)(C)C)C(=O)N[C@@H]([C@@H](C)O)C(=O)N[C@@H](Cc2c[nH]c3c(C)cccc23)C(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)C(C)(C)SSC1(C)C]<br>MeCO-r-Pen(3)-K(d)-T-7MeW-K(PEG2PEG2gEC18OH)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](C(C)(C)SSC(C)(C)[C@@H](C(N[C@H]1CCCCNC(CCC(N[C@H](CC(O)=O)C[N+](C)(C)C)=O)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C |

TABLE 1M-continued
| SEQ ID | Compounds. Structure Peptide Sequence Smiles |
|---|---|
| | (N[C@@H](Cc2cnccc2)C(N(C)CC(N)=O)=O)=O)=O)=O)=O)=O)=O)=O)=O)=O) NC1=O)O |
| 331 | 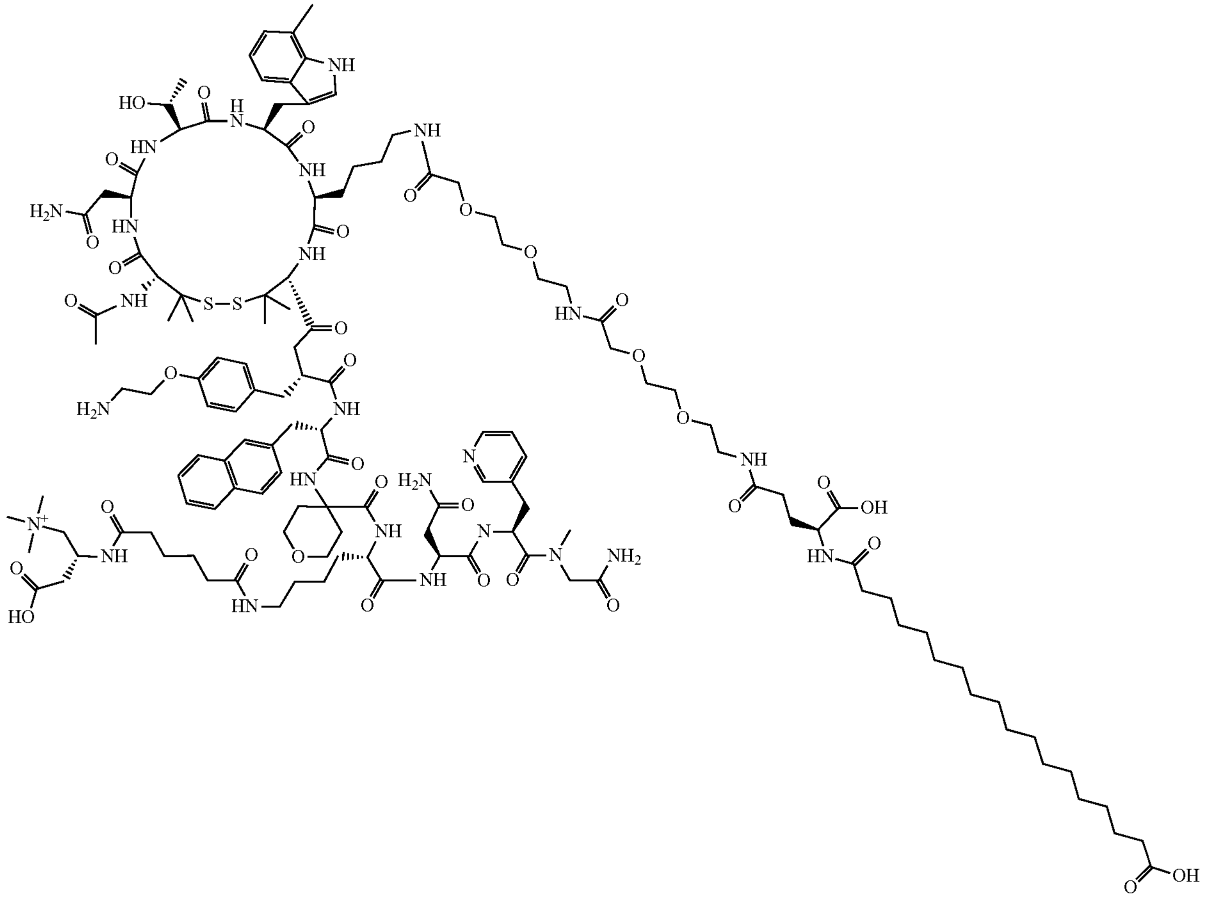 [SMILES: CC(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(=O)N[C@H](C(=O)C[C@@H](Cc2ccc(OCCN)cc2)C(=O)N[C@@H](Cc2ccc3ccccc3c2)C(=O)NC2(C(=O)N[C@@H](CCCCNC(=O)CCCCC(=O)N[C@H](CC(=O)O)C[N+](C)(C)C)C(=O)N[C@@H](CC(N)=O)C(=O)N[C@@H](Cc3cccnc3)C(=O)N(C)CC(N)=O)CCOCC2)C(C)(C)SSC1(C)C] |

TABLE 1M-continued

| Compounds. | |
|---|---|
| SEQ ID | Structure<br>Peptide Sequence<br>Smiles |
| | MeCO-Pen(3)-N-T-7MeW-K(PEG2PEG2gEC18OH)-Pen(3)-AEF-2Nal-THP-K(d)-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(CCC(N[C@H](CC(O)=O)C[N+](C)(C)C)=O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 332 | 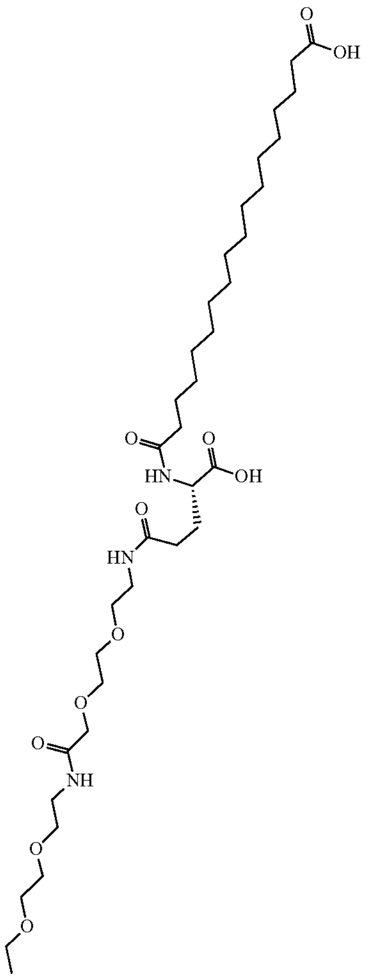 |

TABLE 1M-continued

| Compounds. | |
|---|---|
| SEQ ID | Structure<br>Peptide Sequence<br>Smiles |
| | 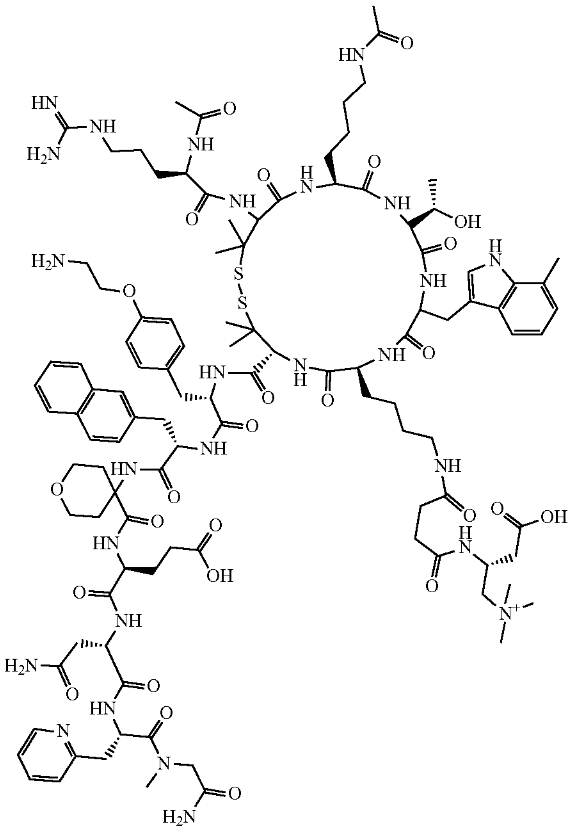<br>MeCO-r-Pen(3)-K(PEG2PEG2gEC18OH)-T-7MeW-K(d)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(CCC(N[C@H](CC(O)=O)C[N+](C)(C)C)=O)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC([C@@H](CCCNC(N)=N)NC(C)=O)=O)C(N[C@@H](Cc(cc2)ccc2OCCN)C(N[C@@H](Cc2cc3c |

TABLE 1M-continued
| SEQ ID | Compounds. Structure Peptide Sequence Smiles |
|---|---|
| | cccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |
| 333 | 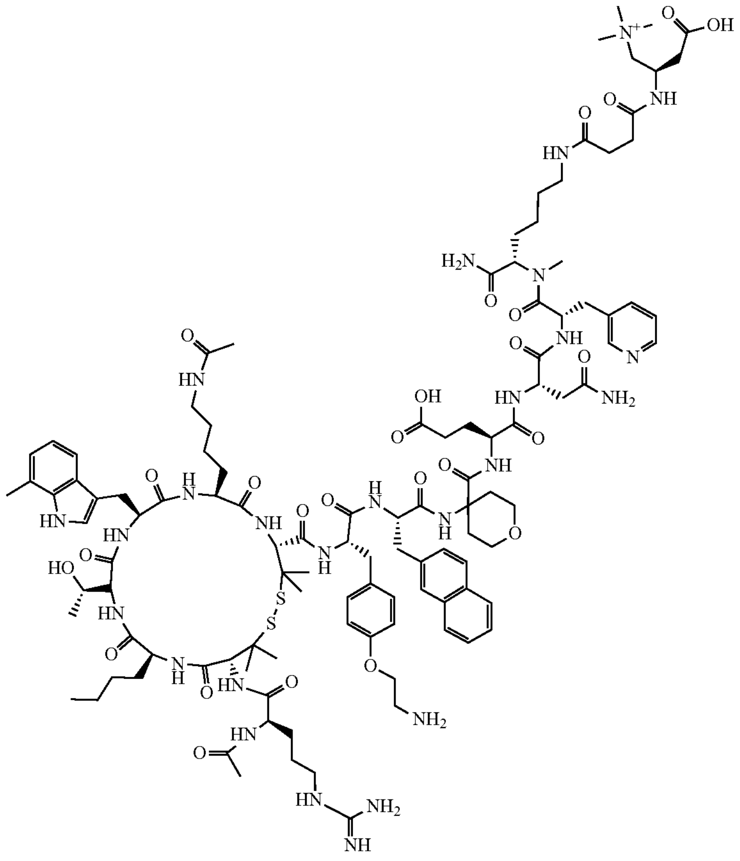 |

TABLE 1M-continued

| Compounds. | |
| --- | --- |
| SEQ ID | Structure<br>Peptide Sequence<br>Smiles |
| | 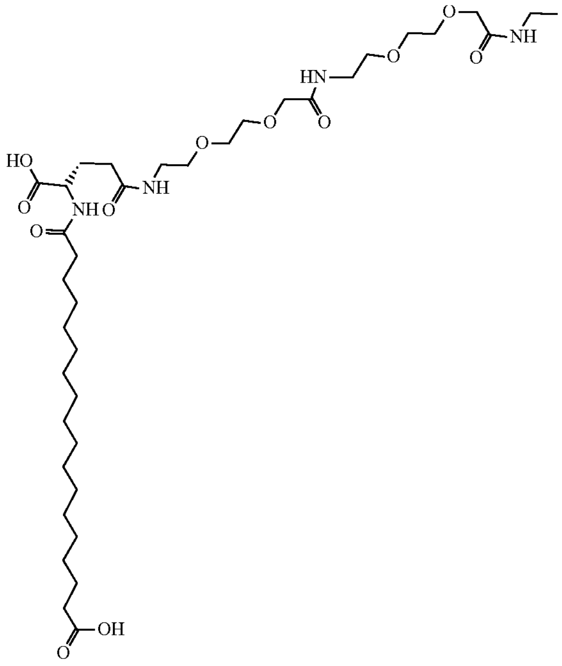<br>MeCO-r-Pen(3)-K(PEG2PEG2gEC18OH)-T-7MeW-K(Ac)-Pen(3)-AEF-2Nal-THP-E-N-3Pya-NMeK(d)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)[C@@H](CCCCNC(CCC(N[C@H](CC(O)=O)C[N+](C)(C)C)=O)=O)C(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 334 | 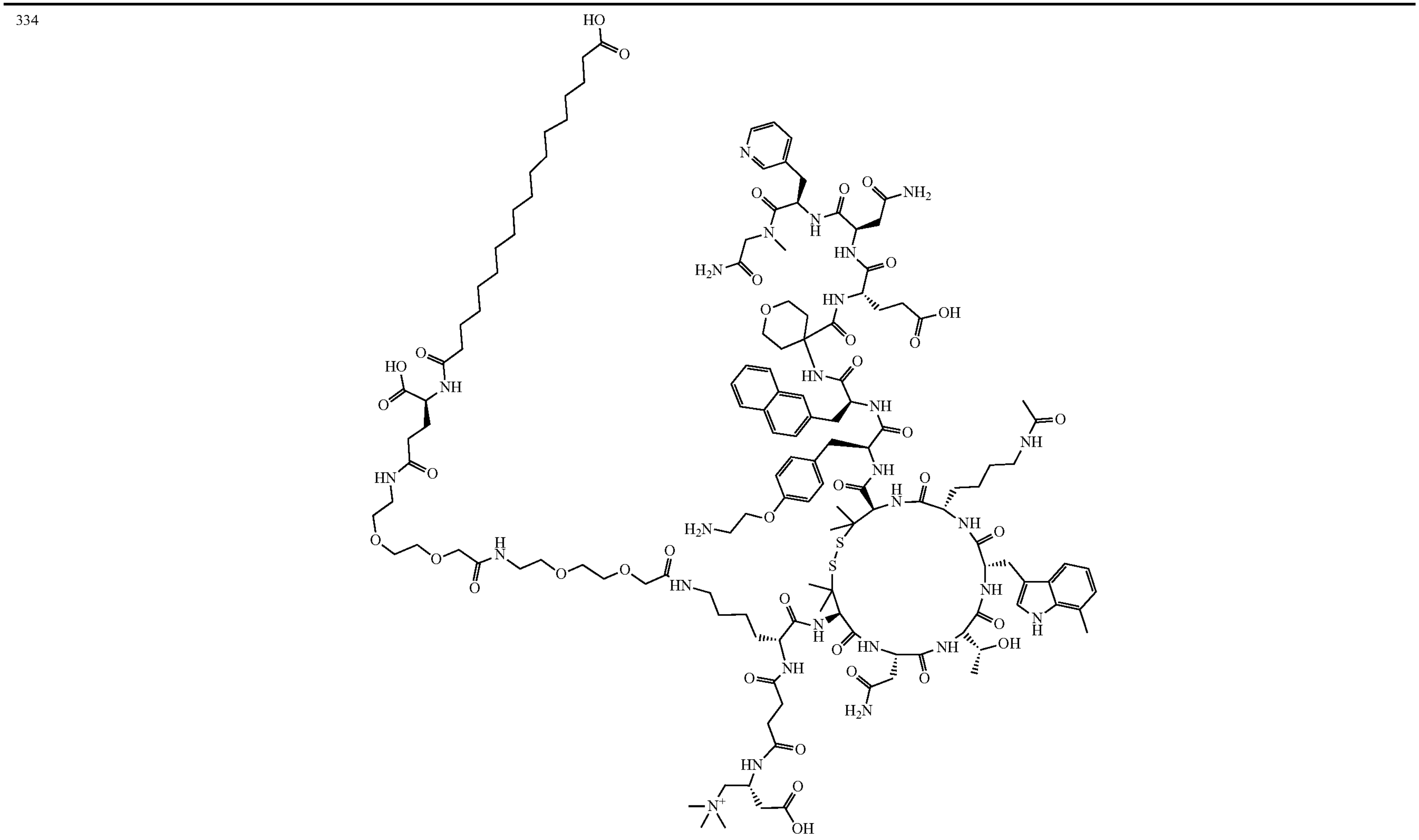 |

TABLE 1M-continued

Compounds.

| SEQ ID | Structure<br>Peptide Sequence<br>Smiles |
|---|---|
| | succiniccarn-k(PEG2PEG2gEC18OH)-Pen(3)-N-T-7MeW-K(Ac)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CCCCCCCCCCCCCCCCC(O)=O)=O)=O)=O)=O)=O)NC(CCC(N[C@H](CC(O)=O)C[N+](C)(C)C)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 335 | 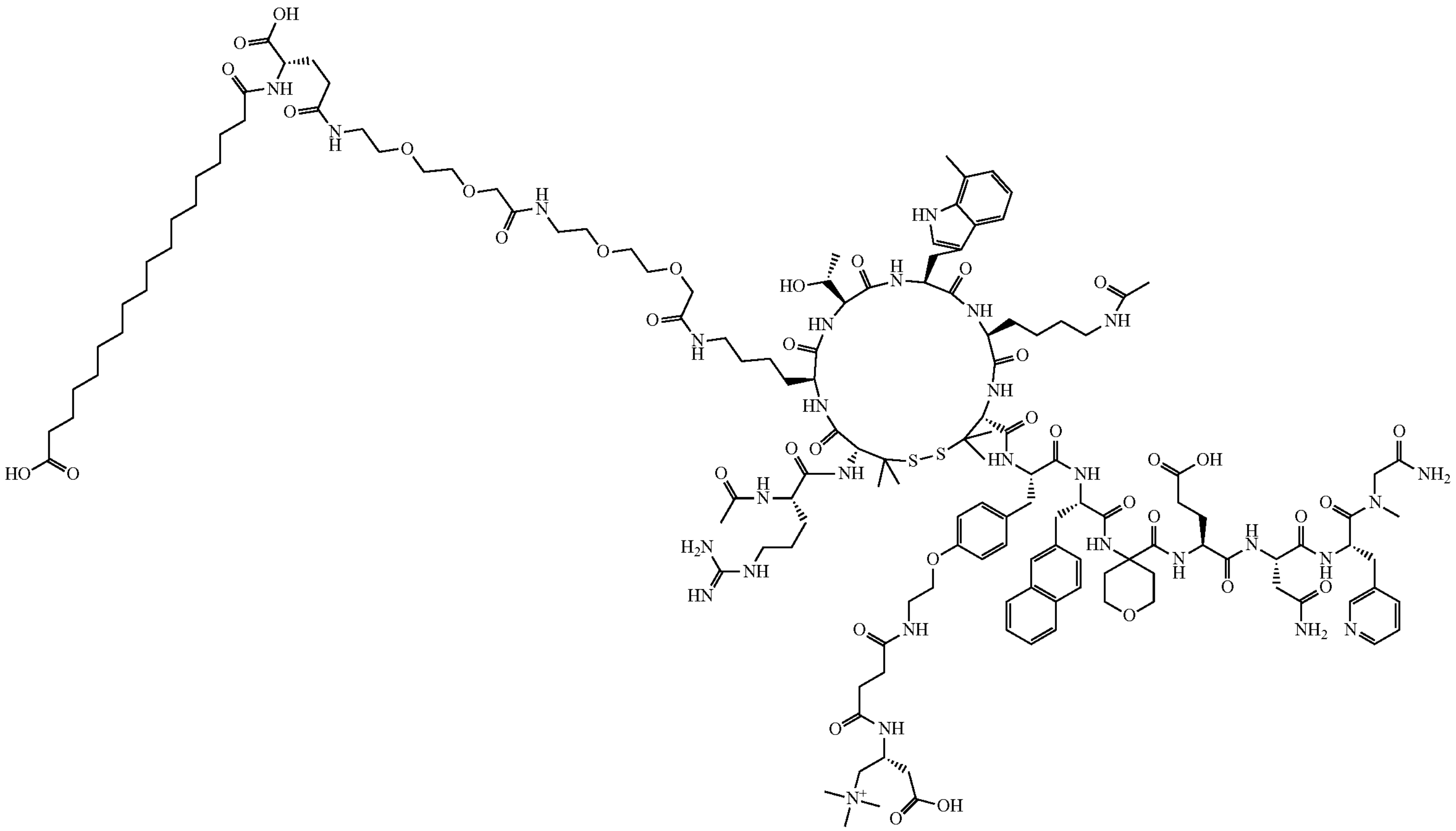 [SMILES: CC(=O)NCCCC[C@@H]1NC(=O)[C@H](Cc2c[nH]c3c(C)cccc23)NC(=O)[C@H]([C@@H](C)O)NC(=O)[C@H](CCCCNC(=O)COCCOCCNC(=O)COCCOCCNC(=O)CC[C@H](NC(=O)CCCCCCCCCCCCCCCCC(=O)O)C(=O)O)NC(=O)[C@@H](NC(=O)[C@H](CCCNC(=N)N)NC(C)=O)C(C)(C)SSC(C)(C)[C@@H](C(=O)N[C@@H](Cc2ccc(OCCNC(=O)CCC(=O)N[C@H](CC(=O)O)C[N+](C)(C)C)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>MeCO-r-Pen(3)-K(PEG2PEG2gEC18OH)-T-7MeW-K(Ac)-Pen(3)-AEF(d)-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC([C@H](CCCNC(N)=N)NC(C)=O)=O)C(N[C@@H](Cc |

TABLE 1M-continued
| Compounds. | |
|---|---|
| SEQ ID | Structure<br>Peptide Sequence<br>Smiles |
| 336 | (cc2)ccc2OCCNC(CCC(N[C@H](CC(O)=O)C[N+](C)(C)C)=O)=O)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=)=O)=O)=O)=O)=O)=O)=O)NC1=O)O<br>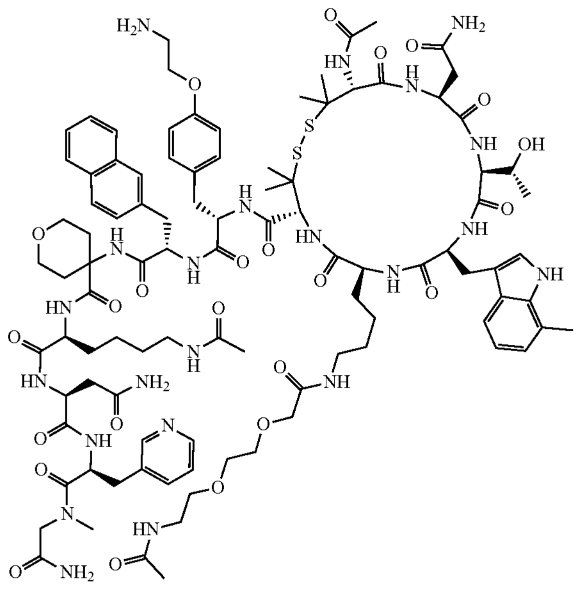 |

TABLE 1M-continued

| Compounds. | |
| --- | --- |
| SEQ ID | Structure<br>Peptide Sequence<br>Smiles |
| | 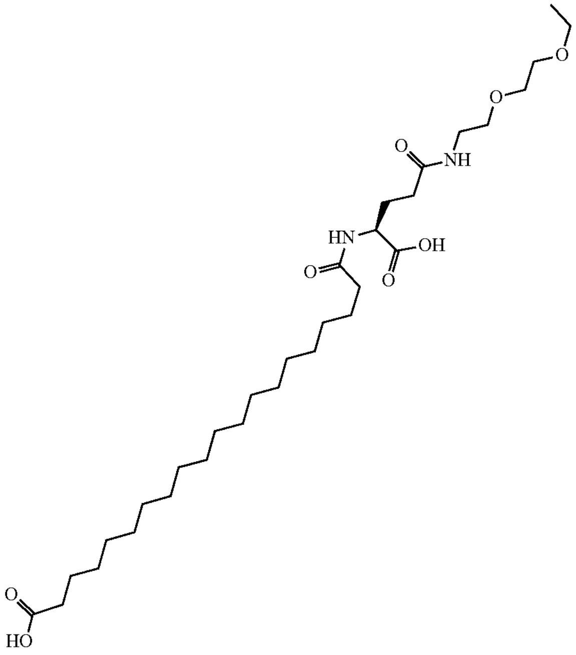<br>MeCO-Pen(3)-N-T-W-K(PEG2PEG2gEC20OH)-Pen(3)-AEF-2Nal-THP-K(Ac)-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCCCC(O)=O)=O)=O)=O)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 337 | 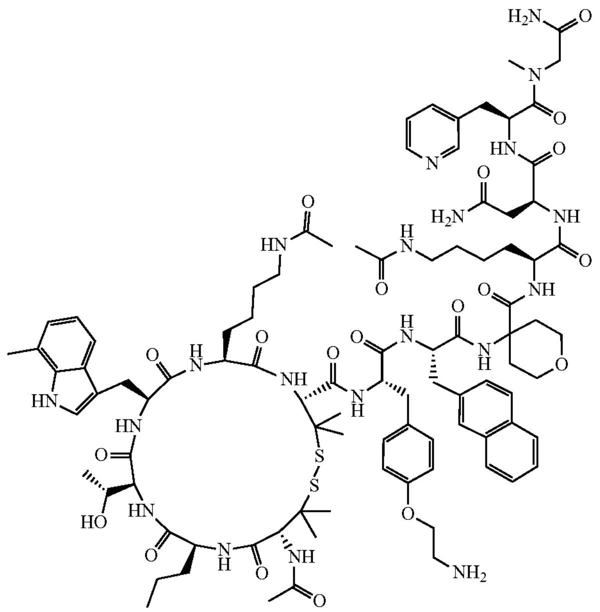 |

TABLE 1M-continued

| Compounds. | |
|---|---|
| SEQ ID | Structure<br>Peptide Sequence<br>Smiles |
| | 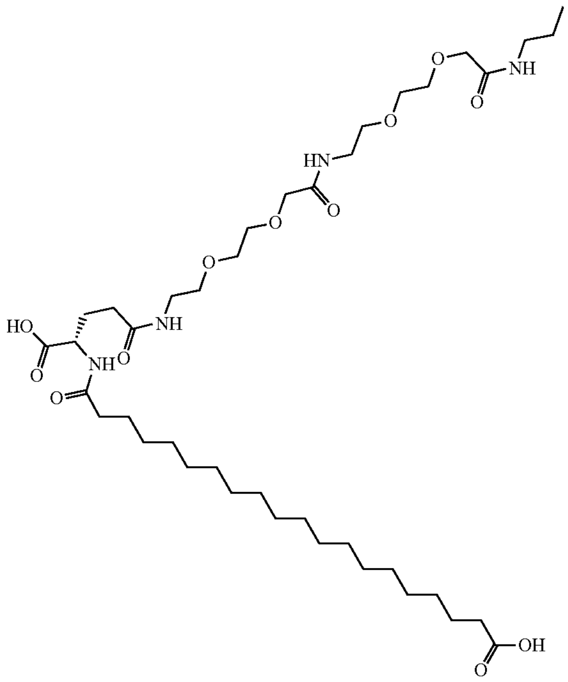<br>MeCO-Pen(3)-K(PEG2PEG2gEC20OH)-T-W-K(Ac)-Pen(3)-AEF-2Nal-THP-K(Ac)-N-3Pya-Sar-CONH2<br>C[C@H]([C@@H](C(N[C@@H](Cc1c[H]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCCCC(O)=O)=O)=O)=O)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 338 | 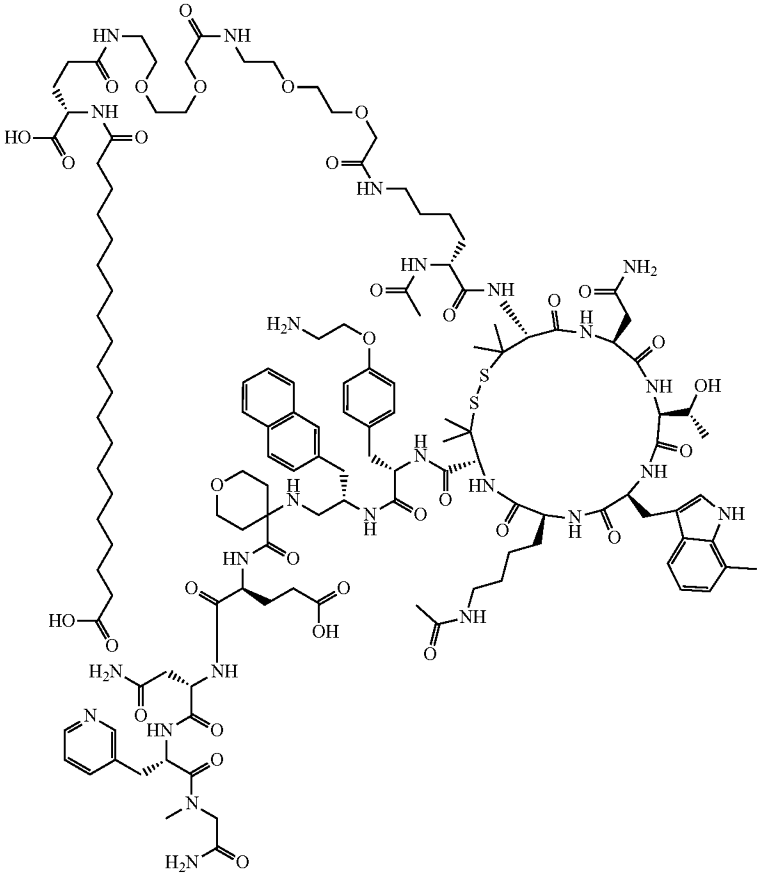 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)COCCOCCNC(=O)COCCOCCNC(=O)CC[C@H](NC(=O)CCCCCCCCCCCCCCCCCCC(=O)O)C(=O)O)NC(C)=O)C(C)(C)SSC(C)(C)[C@@H](C(=O)N[C@@H](Cc2ccc(OCCN)cc2)C(=O)N[C@H](CNC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)Cc2ccc3ccccc3c2)NC1=O]<br>MeCO-K(PEG2PEG2gEC20OH)-Pen(3)-N-T-W-K(Ac)-Pen(3)-AEF-2Nal-THP-K(Ac)-N-3Pya-Sar-CONH2<br>C[C@H]([C@@H](C(N[C@@H](Cc1c[H]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(COCCOCCNC(COCCOCCNC(CC[C@@H](C(O)=O)NC(CC |

TABLE 1M-continued
| Compounds. | |
|---|---|
| SEQ ID | Structure<br>Peptide Sequence<br>Smiles |
| | CCCCCCCCCCCCCCCCC(O)=O)=O)=O)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |
| 339 | 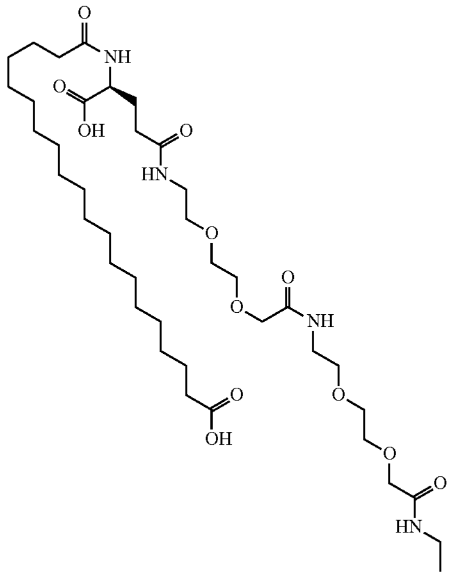 |

TABLE 1M-continued

Compounds.

| SEQ ID | Structure<br>Peptide Sequence<br>Smiles |
|---|---|
| | 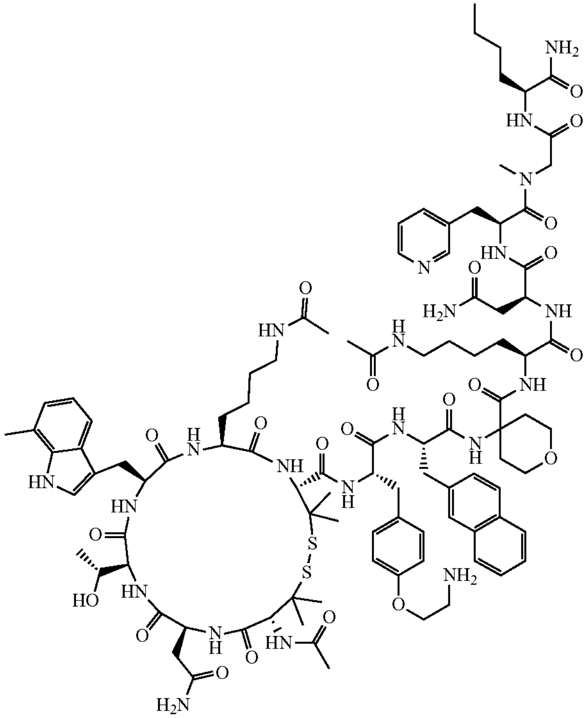<br>MeCO-Pen(3)-N-T-W-K(Ac)-Pen(3)-AEF-2Nal-THP-K(Ac)-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCCCC(O)=O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 340 | 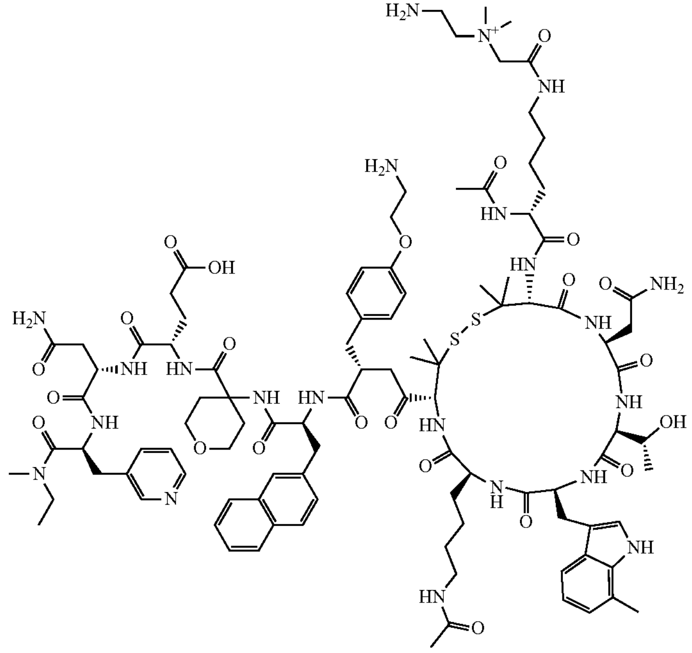 |

TABLE 1M-continued

| Compounds. | |
|---|---|
| SEQ ID | Structure<br>Peptide Sequence<br>Smiles |
| | 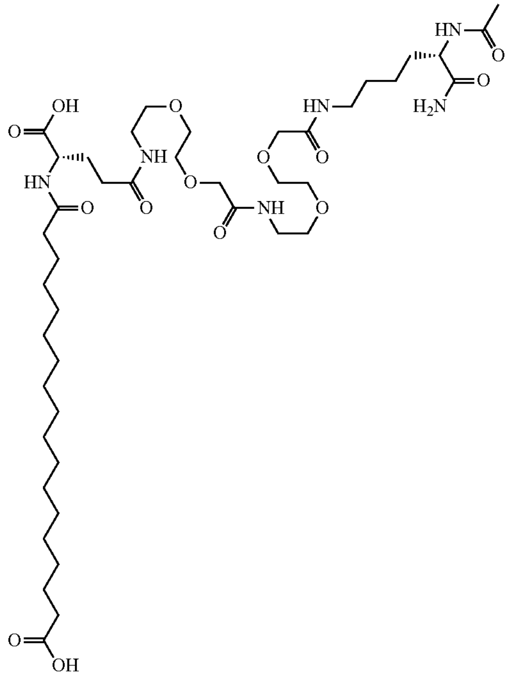<br>MeCO-k(SP6)-Pen(3)-N-T-7MeW-K(Ac)-Pen(3)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(C[N+](C)(C)CCN)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 341 | 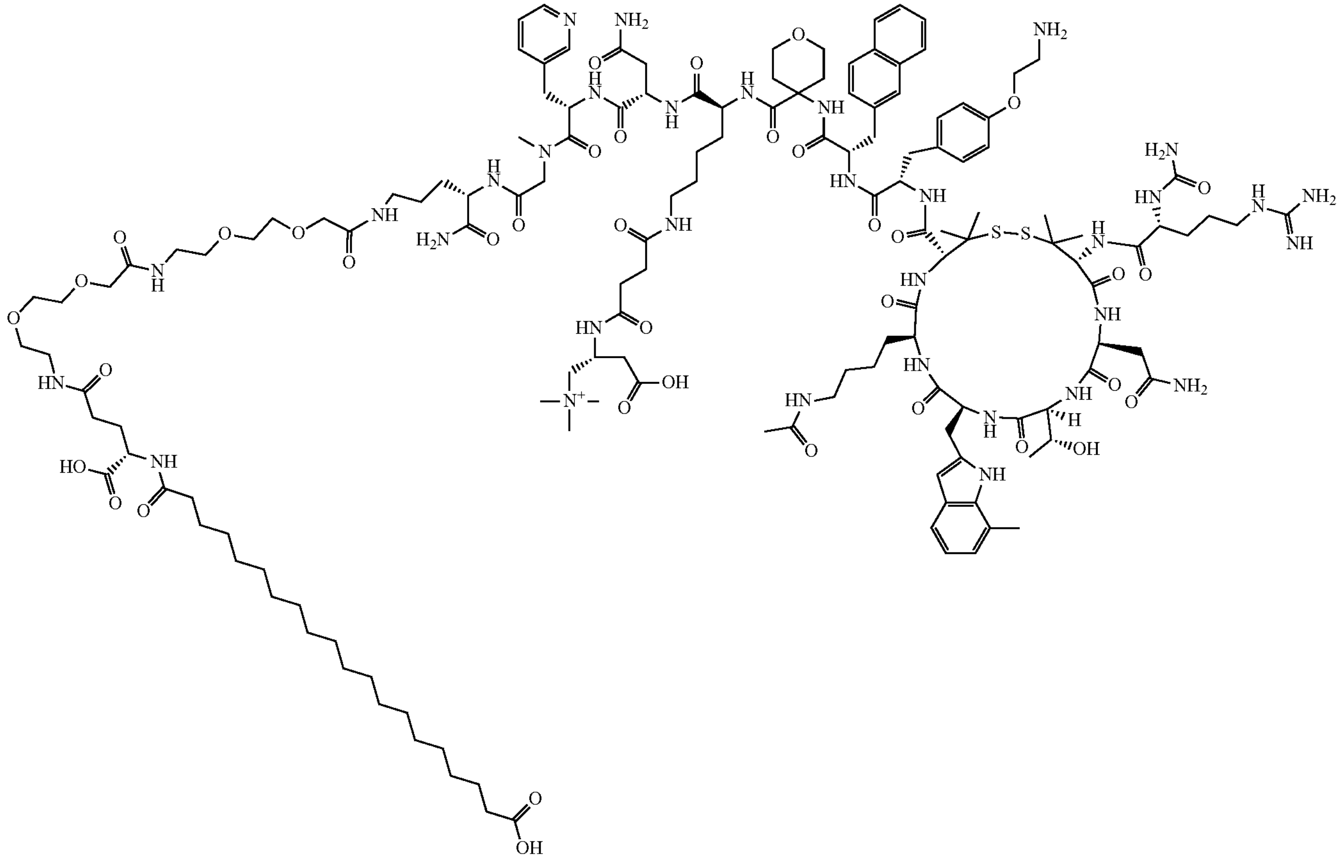 [SMILES: CC(=O)NCCCC[C@@H]1NC(=O)[C@H](Cc2cc3cccc(C)c3[nH]2)NC(=O)[C@H]([C@@H](C)O)NC(=O)[C@H](CC(N)=O)NC(=O)[C@@H](NC(=O)[C@@H](CCCNC(=N)N)NC(N)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(=O)CCC(=O)N[C@H](CC(=O)O)C[N+](C)(C)C)C(=O)N[C@@H](CC(N)=O)C(=O)N[C@@H](Cc3cccnc3)C(=O)N(C)CC(=O)N[C@@H](CCCNC(=O)COCCOCCNC(=O)COCCOCCNC(=O)CC[C@H](NC(=O)CCCCCCCCCCCCCCCCCCC(=O)O)C(=O)O)C(N)=O)CCOCC2)NC1=O]<br>MeCO-r-Pen(3)-N-T-7MeW-K(Ac)-Pen(3)-AEF-2Nal-THP-K(d)-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(CCC(N[C@H] |

TABLE 1M-continued

| Compounds. | |
|---|---|
| SEQ ID | Structure<br>Peptide Sequence<br>Smiles |
| | (CC(O)=O)C[N+](C)(C)C)=O)=O)C(N[C@@H](CC(N)=O)C(N[C@@H](Cc2cnccc 2)C(N(C)CC(N[C@@H](CCCCNC(COCCOCCNC(COCCOCCNC(CC[C@@H] (C(O)=O)NC(CCCCCCCCCCCCCCCCCCC(O)=O)=O)=O)=O)=O)C(N)=O)=O)= O)=O)=O)=O)=O)=O)=O)=O)=O)=O)NC1=O)O |

TABLE 1M-continued
| Compounds. | |
| --- | --- |
| SEQ ID | Structure<br>Peptide Sequence<br>Smiles |
| 342 | 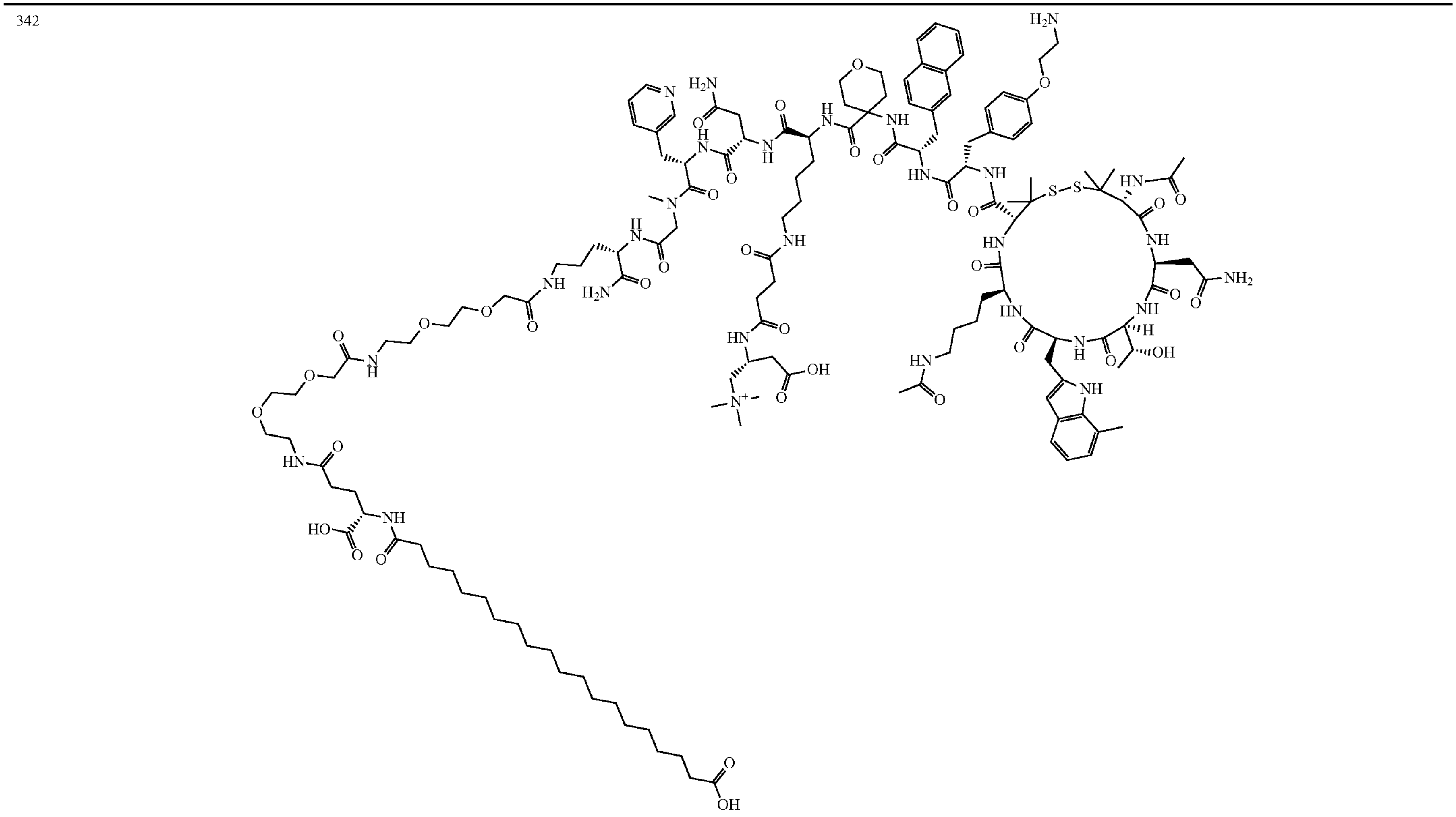 |

TABLE 1M-continued

| Compounds. | |
|---|---|
| SEQ ID | Structure<br>Peptide Sequence<br>Smiles |
| | MeCO-Pen(3)-N-T-7MeW-K(Ac)-Pen(3)-AEF-2Nal-THP-K(d)-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(CCC(N[C@H](CC(O)=O)C[N+](C)(C)C)=O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCC=O)NC1=O)O |

TABLE 1M-continued
| SEQ ID | Compounds. Structure Peptide Sequence Smiles |
|---|---|
| 343 | 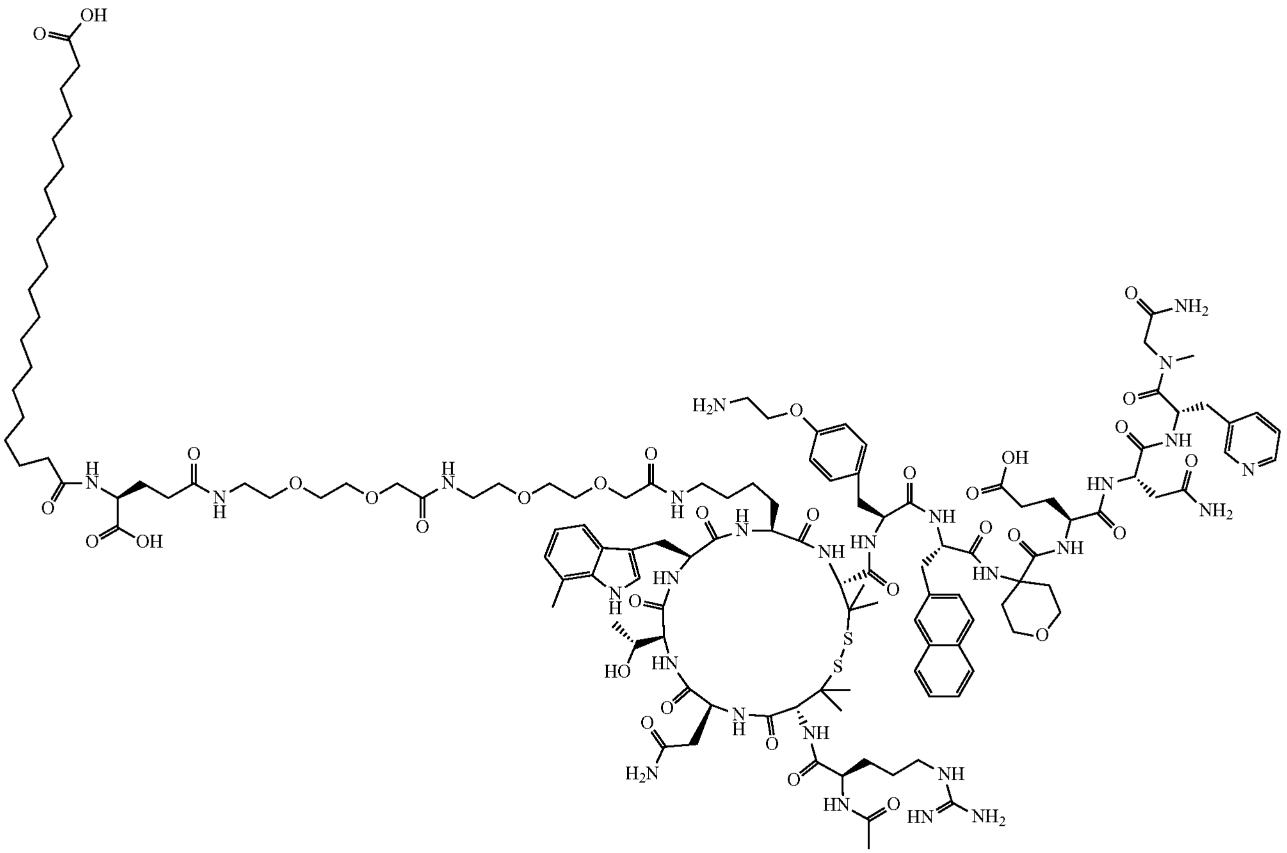 [SMILES: CC(=O)N[C@H](CCCNC(=N)N)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(=O)COCCOCCNC(=O)COCCOCCNC(=O)CC[C@H](NC(=O)CCCCCCCCCCCCCCCCCCC(=O)O)C(=O)O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)C(C)(C)SSC1(C)C] MeCO-r-Pen(3)-N-T-7MeW-K(PEG2PEG2gEC20OH)-Pen(3)-AEF-2Nal-THP-E-N-3Pya-Sar-CONH2 C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCCCCC(O)=O)=O)=O)=O)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc |

TABLE 1M-continued

| SEQ ID | Compounds. Structure Peptide Sequence Smiles |
|---|---|
| | 2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |
| 344 | 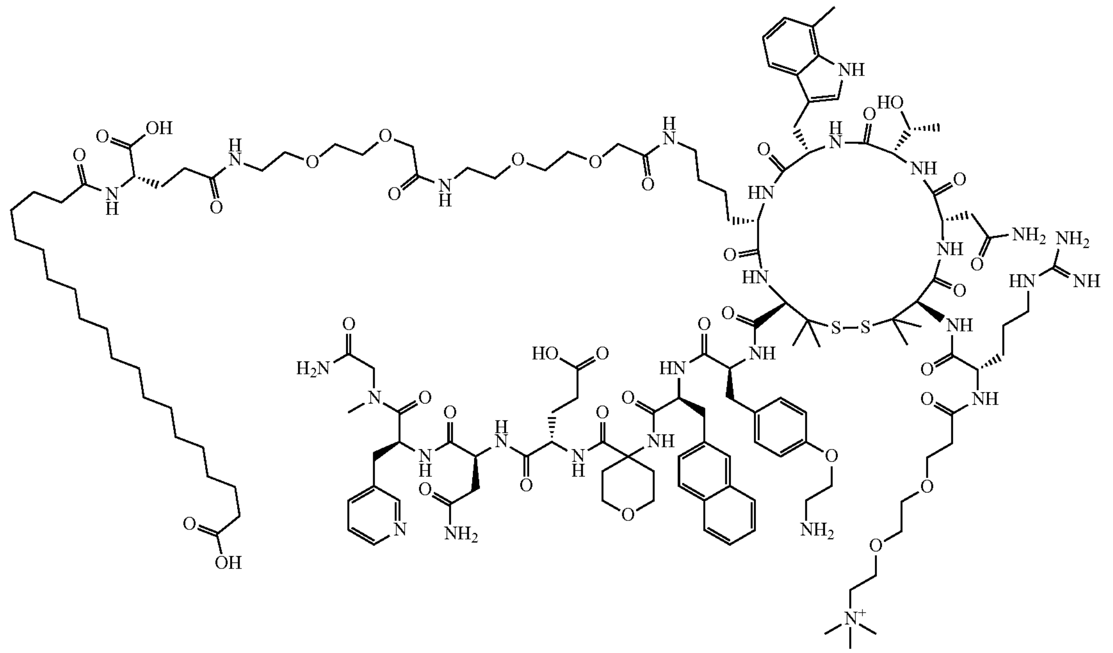 [SMILES: Cc1cccc2c(C[C@@H]3NC(=O)[C@H]([C@@H](C)O)NC(=O)[C@H](CC(N)=O)NC(=O)[C@@H](NC(=O)[C@H](CCCNC(=N)N)NC(=O)CCOCCOCC[N+](C)(C)C)C(C)(C)SSC(C)(C)[C@@H](C(=O)N[C@@H](Cc4ccc(OCCN)cc4)C(=O)N[C@@H](Cc4ccc5ccccc5c4)C(=O)NC4(C(=O)N[C@@H](CCC(=O)O)C(=O)N[C@@H](CC(N)=O)C(=O)N[C@@H](Cc5cccnc5)C(=O)N(C)CC(N)=O)CCOCC4)NC(=O)[C@H](CCCCNC(=O)COCCOCCNC(=O)COCCOCCNC(=O)CC[C@H](NC(=O)CCCCCCCCCCCCCCCCCCC(=O)O)C(=O)O)NC3=O)c[nH]c12] cPEG3aCO-r-Pen(3)-N-T-7MeW-K(PEG2PEG2gEC20OH)-Pen(3)-AEF-2Nal-THP-E-N-3Pya-Sar-CONH2 C[C@H]([C@@H](C(N[C@@H](Cc1c[H]c2c1cccc2C)C(N[C@@H](CCCCNC(COCCOCCNC(COCCOCCNC(CC[C@@H](C(O)=O)NC(CCCCCCCCCCCCCCCCCCC(O)=O)=O)=O)=O)=O)C(N[C@@H](C(C)(C)SSC(C)(C)[C@@H](C(N[C@H]1CC(N)=O)=O)NC([C@@H](CCCNC(N)=N)NC(CCOCCOCC[N+](C)(C)C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 345 | 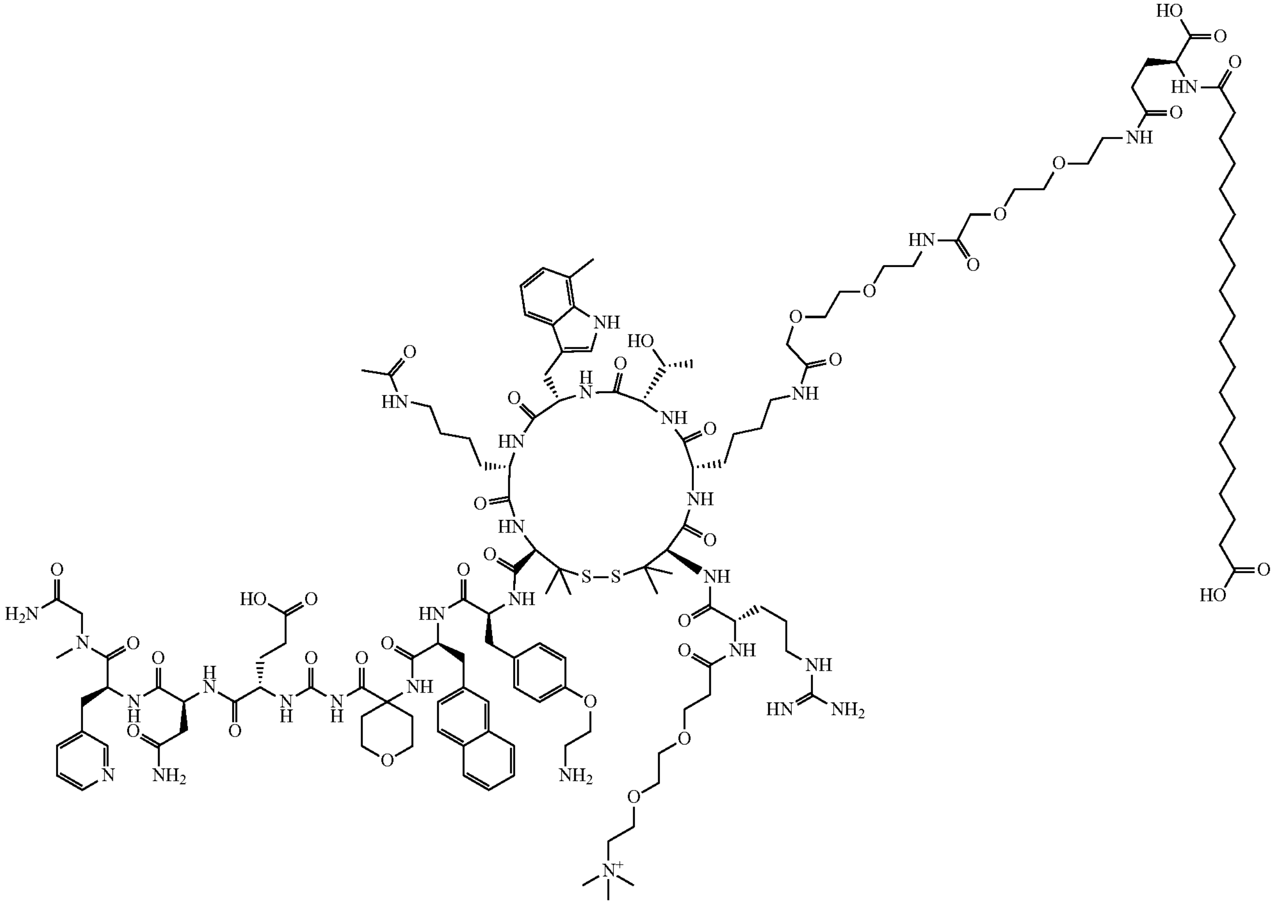 [SMILES: CC(=O)NCCCC[C@@H]1NC(=O)[C@H](Cc2c[nH]c3c(C)cccc23)NC(=O)[C@H]([C@@H](C)O)NC(=O)[C@H](CCCCNC(=O)COCCOCCNC(=O)COCCOCCNC(=O)CC[C@H](NC(=O)CCCCCCCCCCCCCCCCCCC(=O)O)C(=O)O)NC(=O)[C@@H](NC(=O)[C@H](CCCNC(=N)N)NC(=O)CCOCCOCC[N+](C)(C)C)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)NC(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>cPEG3aCO-r-Pen(3)-K(PEG2PEG2gEC20OH)-T-7MeW-K(Ac)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCO |

TABLE 1M-continued
| SEQ ID | Compounds. Structure Peptide Sequence Smiles |
|---|---|
| 346 | CCNC(COCCOCCNC(CC[C@@H](C(O)=O)NC(CCCCCCCCCCCCCCCCCCCC(O)=O)=O)=O)=O)=O)=O)NC([C@@H](CCCNC(N)=N)NC(CCOCCOCC[N+](C)(C)C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)NC1=O)O 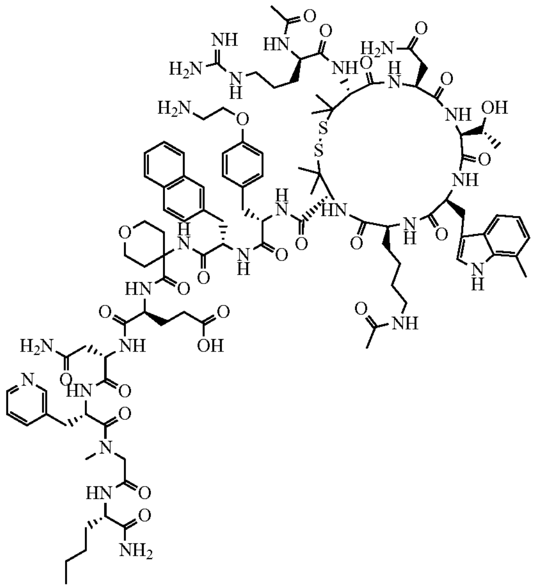 |

TABLE 1M-continued

| Compounds. | |
|---|---|
| SEQ ID | Structure<br>Peptide Sequence<br>Smiles |
| | 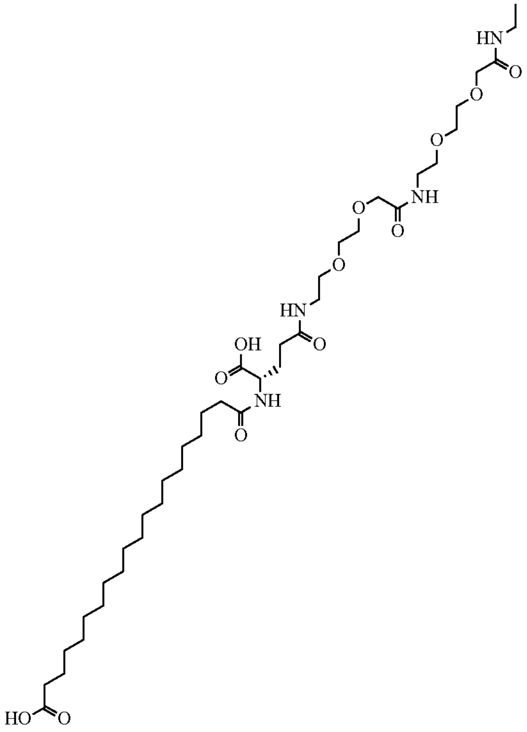<br>MeCO-r-Pen(3)-N-T-7MeW-K(Ac)-Pen(3)-AEF-2Nal-THP-E-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCCCC(O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 347 | 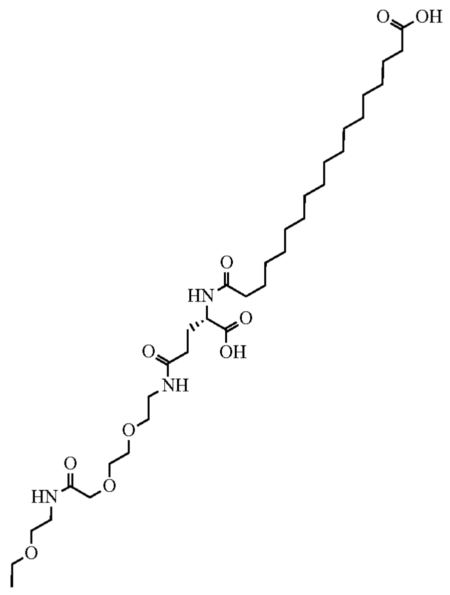 |

TABLE 1M-continued

| Compounds. | |
|---|---|
| SEQ ID | Structure<br>Peptide Sequence<br>Smiles |
| | 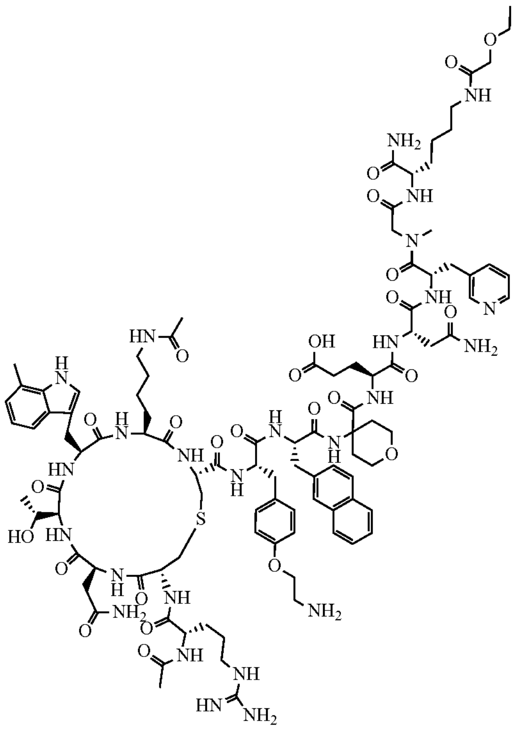<br>MeCO-r-Abu(1)-N-T-7MeW-K(Ac)-C(1)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](CSCC[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 348 | 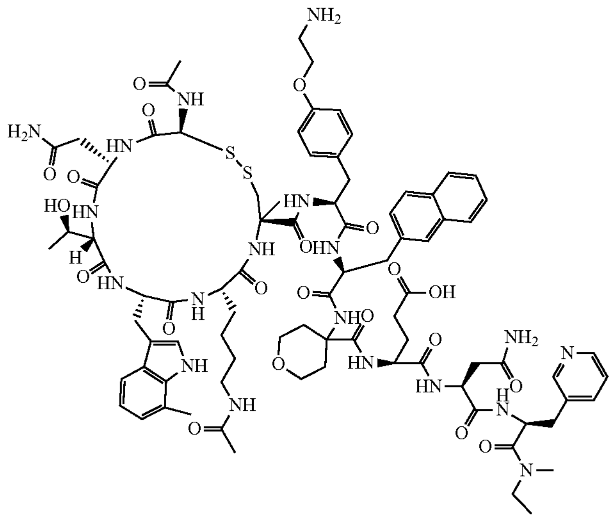 |

TABLE 1M-continued

| Compounds. | |
|---|---|
| SEQ ID | Structure<br>Peptide Sequence<br>Smiles |
| | 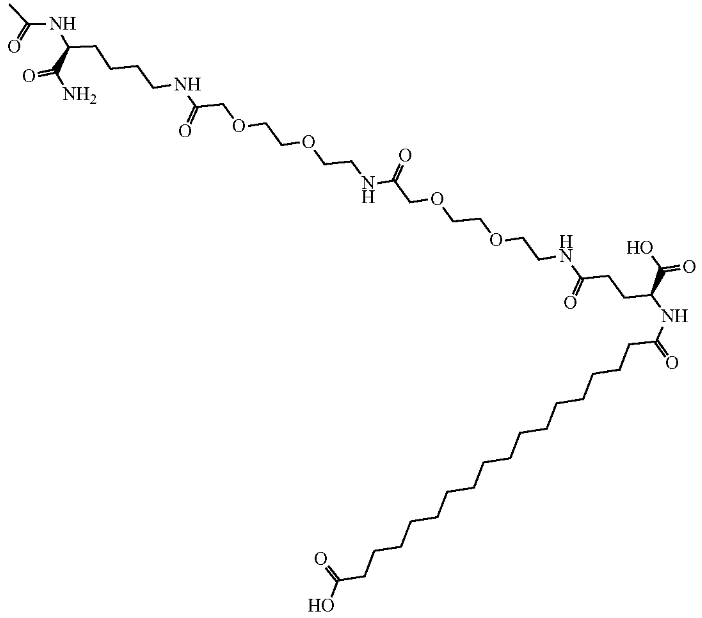<br>MeCO-C(3)-N-T-7MeW-K(Ac)-aMeC(3)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@](C)(CSSC[C@@H](C(N[C@H]1CC(N)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 349 | 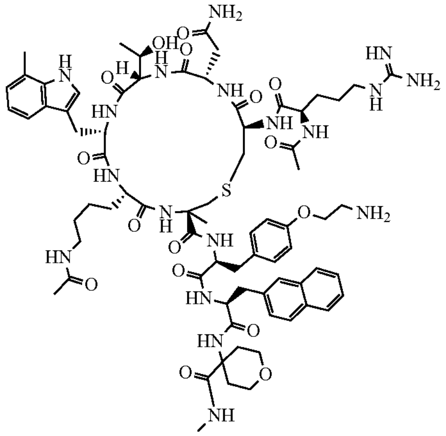 |

TABLE 1M-continued
| Compounds. | |
|---|---|
| SEQ ID | Structure<br>Peptide Sequence<br>Smiles |
| | 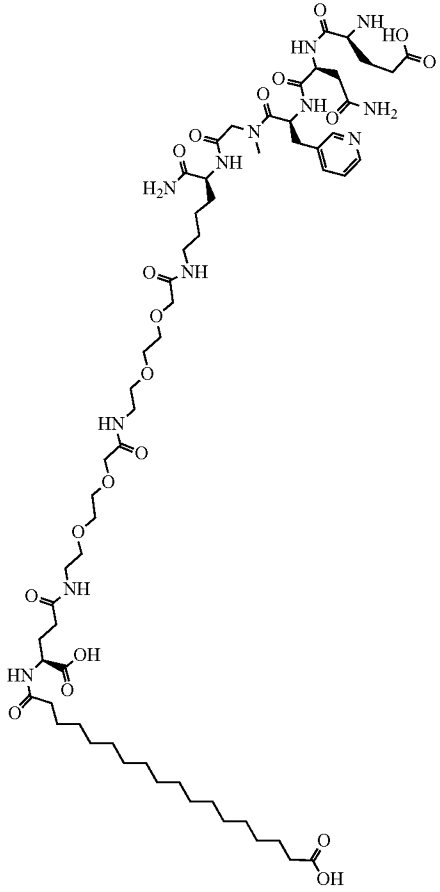<br>MeCO-r-Abu(1)-N-T-7MeW-K(Ac)-aMeC(1)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@](C)(CSCC[C@@H](C(N[C@H]1CC(N)=O)=O)NC([C@@H](C |

TABLE 1M-continued
| Compounds. | |
|---|---|
| SEQ ID | Structure<br>Peptide Sequence<br>Smiles |
| 350 | CCNC(N)=N)NC(C)=O)=O)C(N[C@@H](Cc(cc2)ccc2OCCN)C(N[C@@H](Cc2c c3ccccc3cc2)C(NC2(CCOCC2)C(N[C@@H](CCC(O)=O)C(N[C@@H](CC(N)=O) C(N[C@@H](Cc2cnccc2)C(N(C)CC(N[C@@H](CCCCNC(COCCOCCNC(COCC OCCNC(CC[C@@H](C(O)=O)NC(CCCCCCCCCCCCCCCCC(O)=O)=O)=O)=O)=O)= O)C(N)=O)=O)=O)=O)=O)=O)=O)=O)=O)=O)=O)=O)NC1=O)O<br>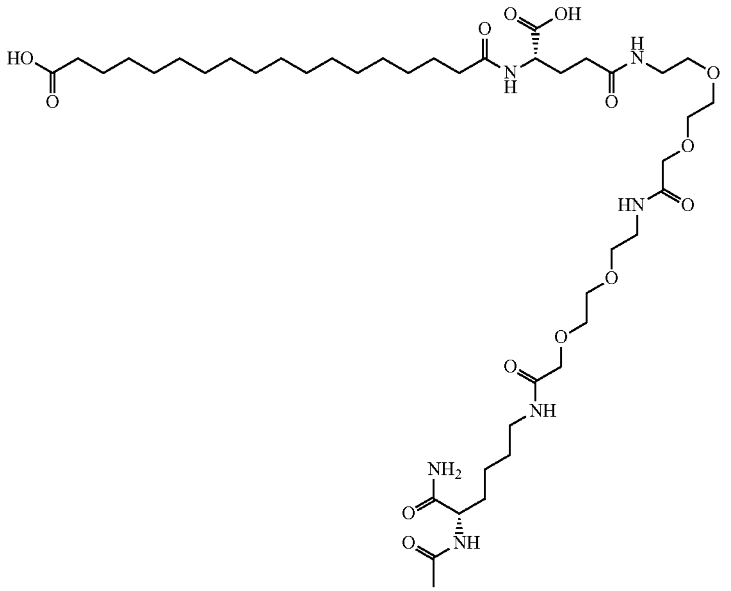 |

TABLE 1M-continued

| Compounds. | |
|---|---|
| SEQ ID | Structure<br>Peptide Sequence<br>Smiles |
| | 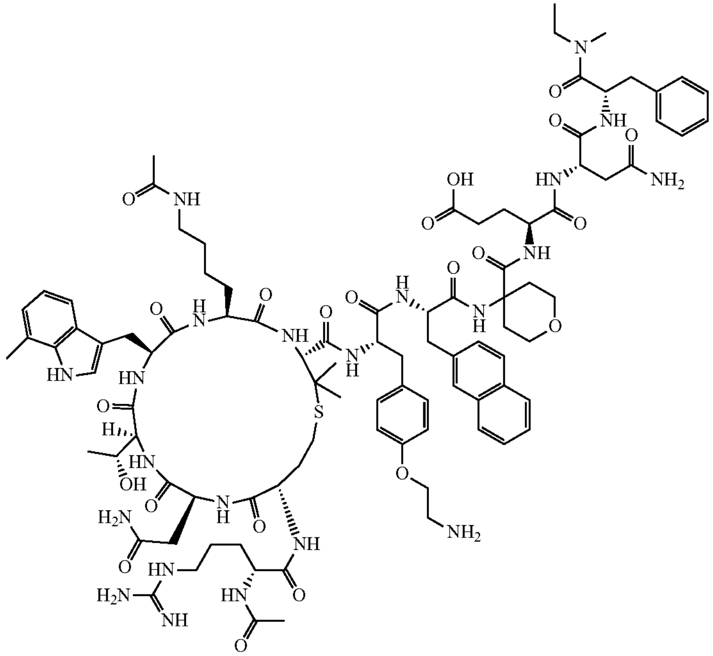<br>MeCO-r-Abu(1)-N-T-7MeW-K(Ac)-Pen(1)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SCC[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 351 | 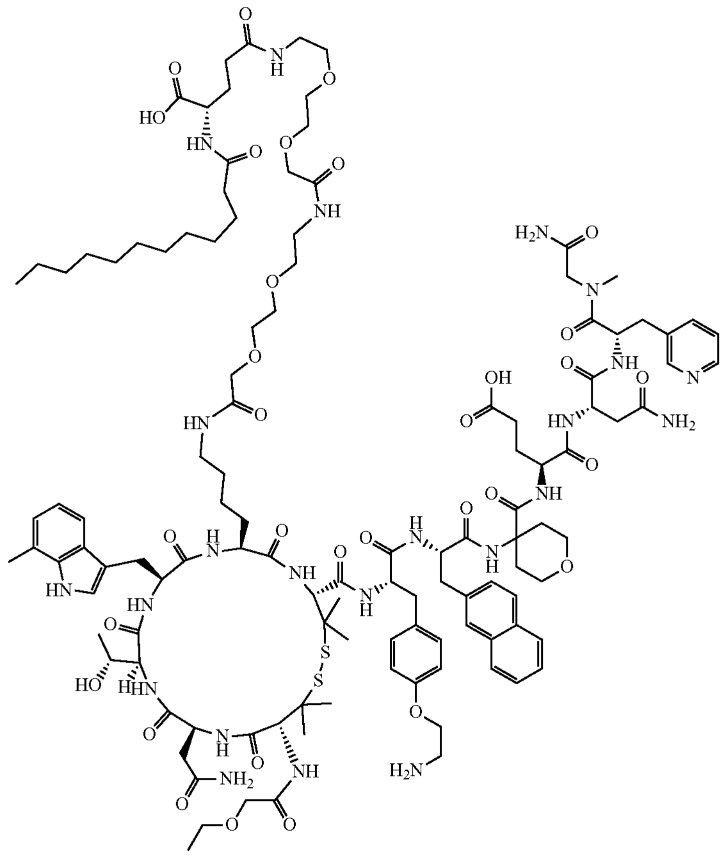 |

TABLE 1M-continued

| SEQ ID | Compounds. Structure Peptide Sequence Smiles |
|---|---|
| | 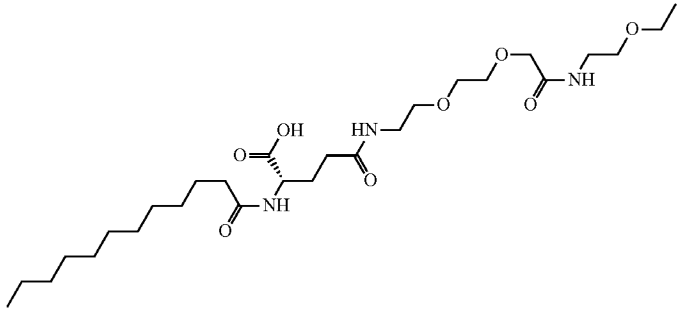<br>C12gEPEG2PEG2CO-Pen(3)-N-T-7MeW-K(PEG2PEG2gEC12)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(COCCOCCNC(COCCOCCNC(CC[C@@H](C(O)=O)NC(CCCCCCCCCCC)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)NC1=O)=O)=O)=O)C(O)=O)=O |

TABLE 1M-continued
| Compounds. | |
| --- | --- |
| SEQ ID | Structure<br>Peptide Sequence<br>Smiles |
| 352 | 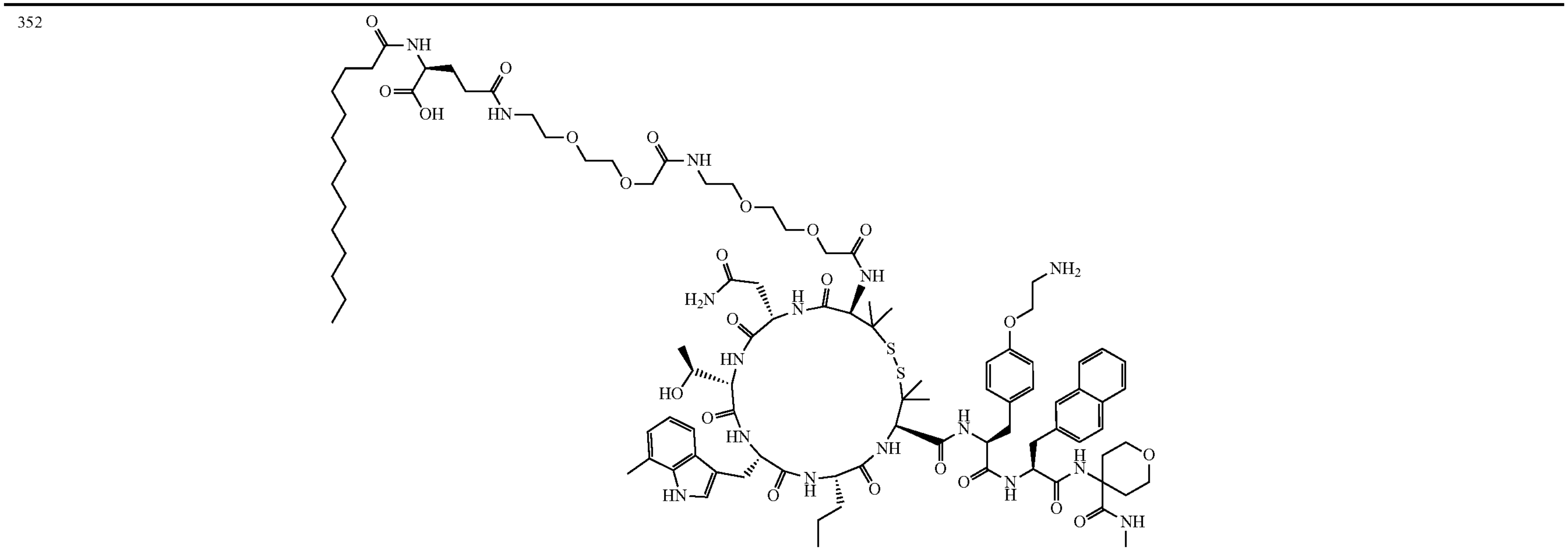 |

TABLE 1M-continued

| Compounds. | |
|---|---|
| SEQ ID | Structure<br>Peptide Sequence<br>Smiles |
| | 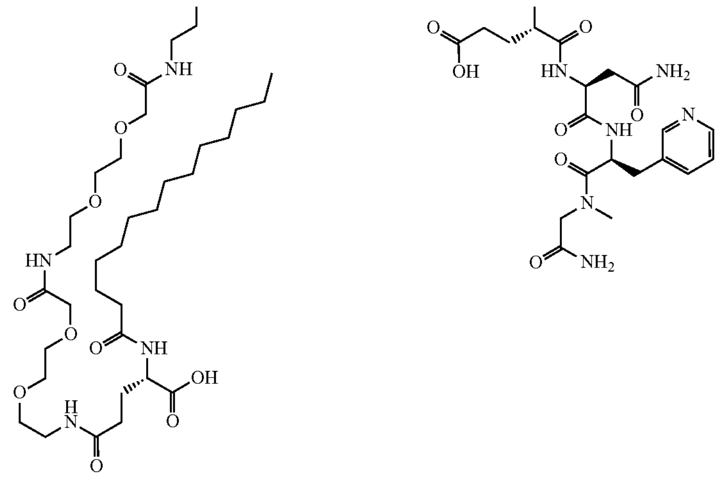<br>C14gEPEG2PEG2CO-Pen(3)-N-T-7MeW-K(PEG2PEG2gEC14)-Pen(3)-AEF-2Nal-THP-E-N-3Pya-Sar-CONH2<br>CCCCCCCCCCCCCC(N[C@@H](CCC(NCCOCCOCC(NCCOCCOCC(NCCCC[C@@H(C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(COCCOCCNC(COCCOCCNC(CC[C@@H](C(O)=O)NC(CCCCCCCCCCCCC)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued
| Compounds. | |
|---|---|
| SEQ ID | Structure<br>Peptide Sequence<br>Smiles |
| 353 | 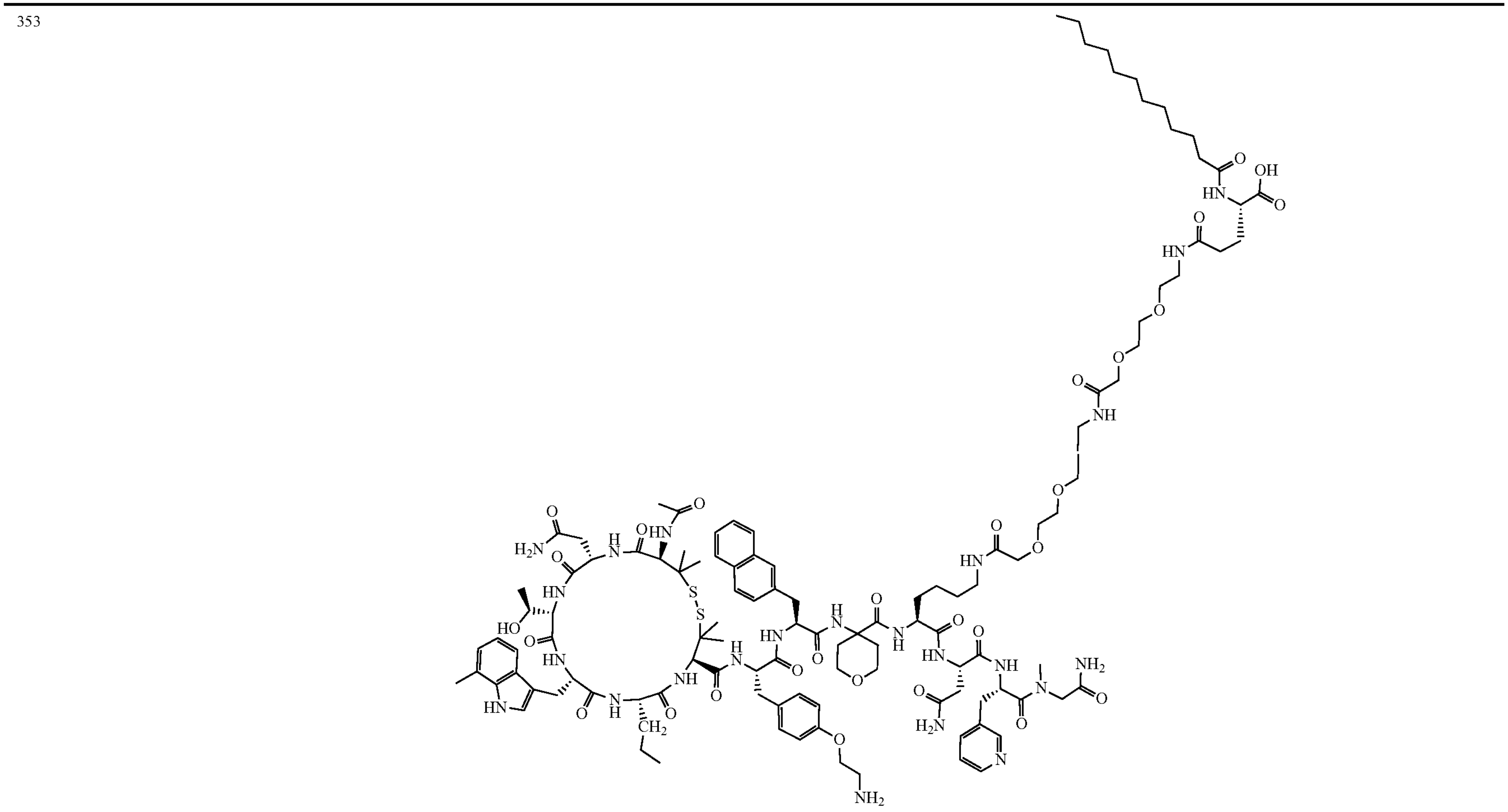 |

TABLE 1M-continued

Compounds.

| SEQ ID | Structure<br>Peptide Sequence<br>Smiles |
| --- | --- |
| | 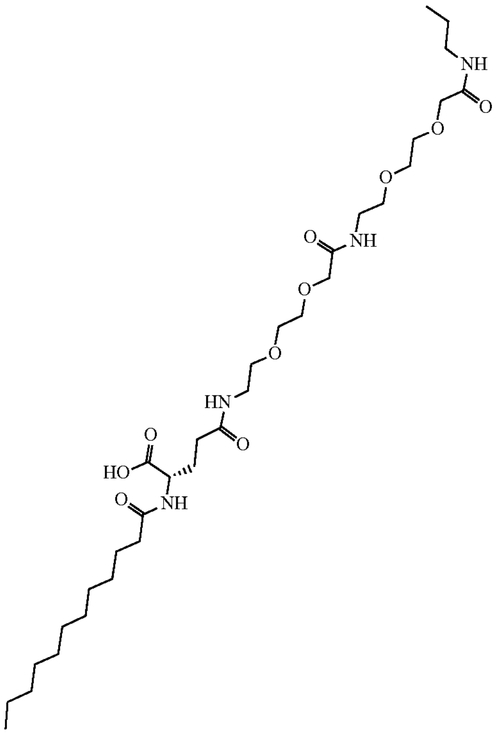<br>MeCO-Pen(3)-N-T-7MeW-K(PEG2PEG2gEC12)-Pen(3)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(COCCOCCNC(COCCOCCNC(CC[C@@H](C(O)=O)NC(CCCCCCCCCCC)=O)=O)=O)=O)=O)=O)=O)=O)NC(C)=O)NC1=O)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 354 | 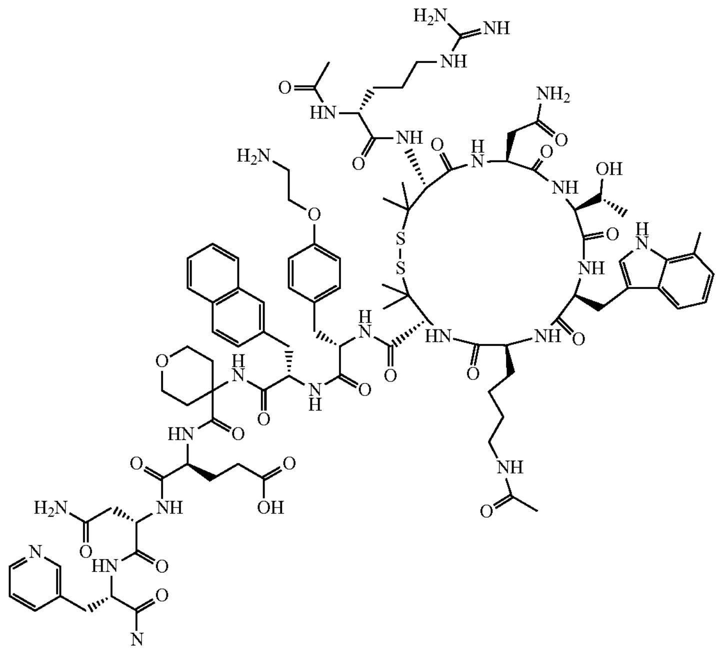 |

TABLE 1M-continued

| SEQ ID | Compounds. Structure Peptide Sequence Smiles |
| --- | --- |
| | 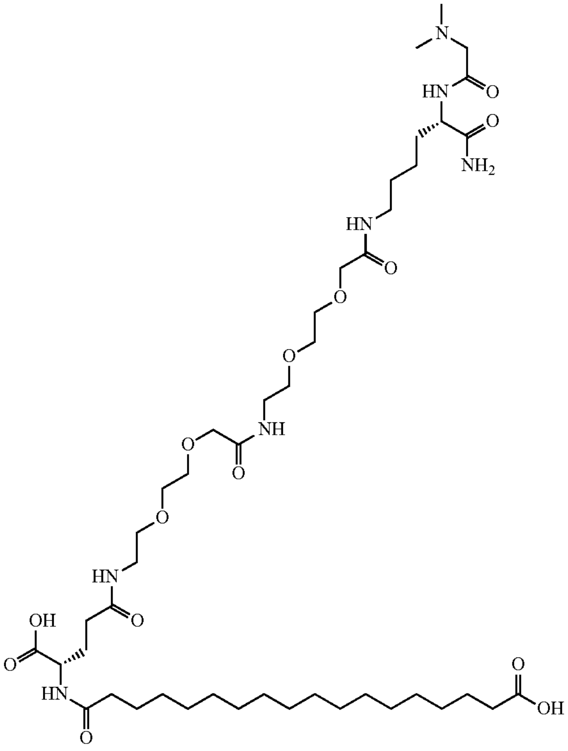<br>MeCO-r-Pen(3)-N15-T-7MeW-K(Ac)-Pen(3)-AEF-2Nal-THP-E-N15-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C([15NH][13C@H]1[13CH2][13C]([15NH2])=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C([15NH][13C@@H]([13CH2][13C]([15NH2])=O)[13C](N[C@ @H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)=O)=O)=O)=O)N[13C]1=O)O |

TABLE 1M-continued
| Compounds. | |
|---|---|
| SEQ ID | Structure<br>Peptide Sequence<br>Smiles |
| 355 | 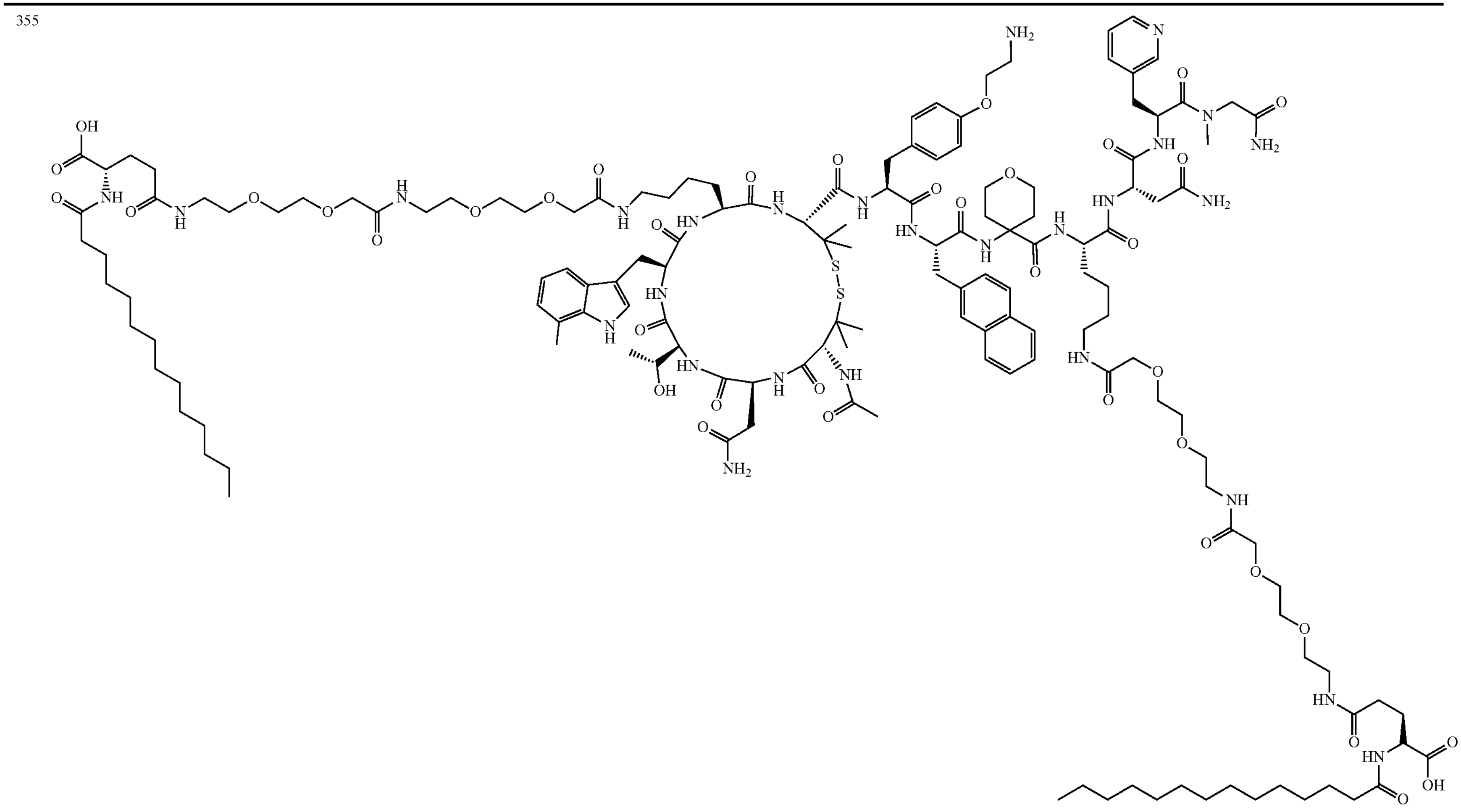 |

TABLE 1M-continued

| Compounds. | |
|---|---|
| SEQ ID | Structure<br>Peptide Sequence<br>Smiles |
| | MeCO-Pen(3)-N-T-7MeW-K(PEG2PEG2gEC14)-Pen(3)-AEF-2Nal-THP-K(PEG2PEG2gEC14)-N-3Pya-Sar-CONH2<br>CCCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1CCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(COCCOCCNC(COCCOCCNC(CC[C@@H](C(O)=O)NC(CCCCCCCCCCCCCC)=O)=O)=O)=O)=O)=O)=O)=O)NC(C)=O)NC1=O)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 356 | 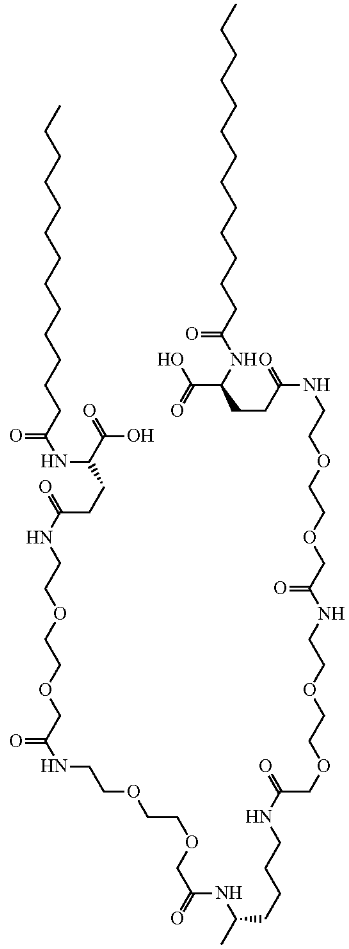 |

TABLE 1M-continued

| SEQ ID | Compounds. Structure Peptide Sequence Smiles |
|---|---|
| | 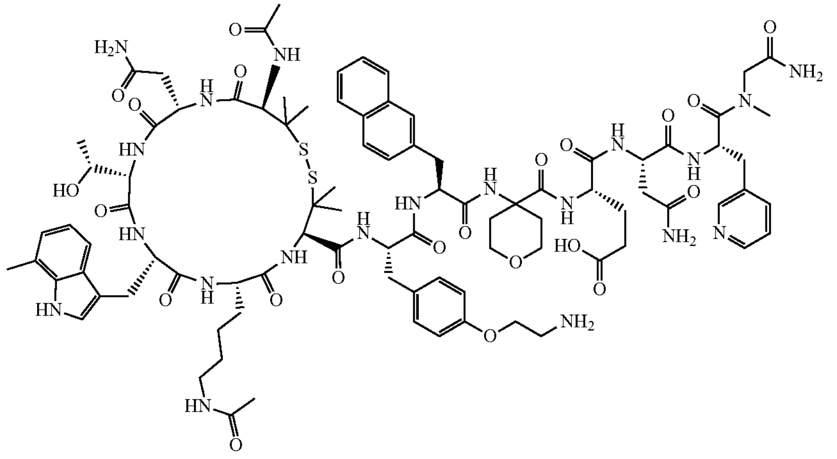<br>C14gEPEG2PEG2CO-k(PEG2PEG2gEC14)-Pen(3)-N-T-7MeW-K(Ac)-Pen(3)-AEF-2Nal-THP-E-N-3Pya-Sar-CONH2<br>CCCCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)=O)NC([C@H](CCCCNC(C)=O)NC([C@H](Cc1c[nH]c2c1cccc2C)NC([CCCOCCNC(COCCOCCNC(CC[C@@H](C(O)=O)NC(CCCCCCCCCCCCC)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 357 | 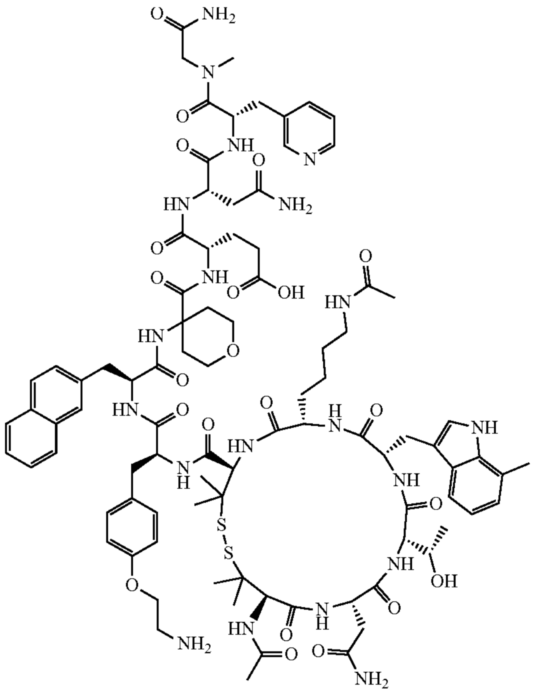 |

TABLE 1M-continued

| SEQ ID | Compounds. Structure Peptide Sequence Smiles |
|---|---|
| | 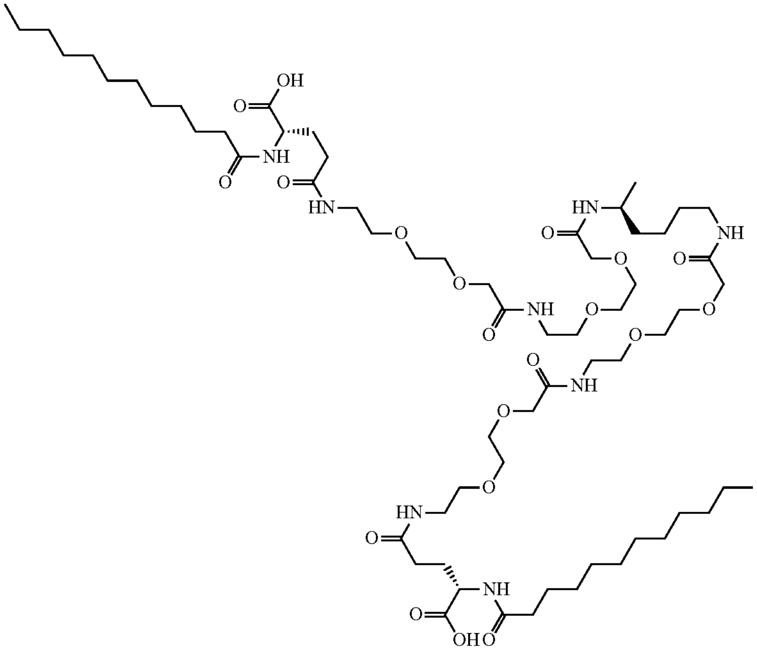<br>C12gEPEG2PEG2CO-k(PEG2PEG2gEC12)-Pen(3)-N-T-7MeW-K(Ac)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(COCCOCCNC(COCCOCCNC(CC[C@@H](C(O)=O)NC(CCCCCCCCCCC)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 358 | 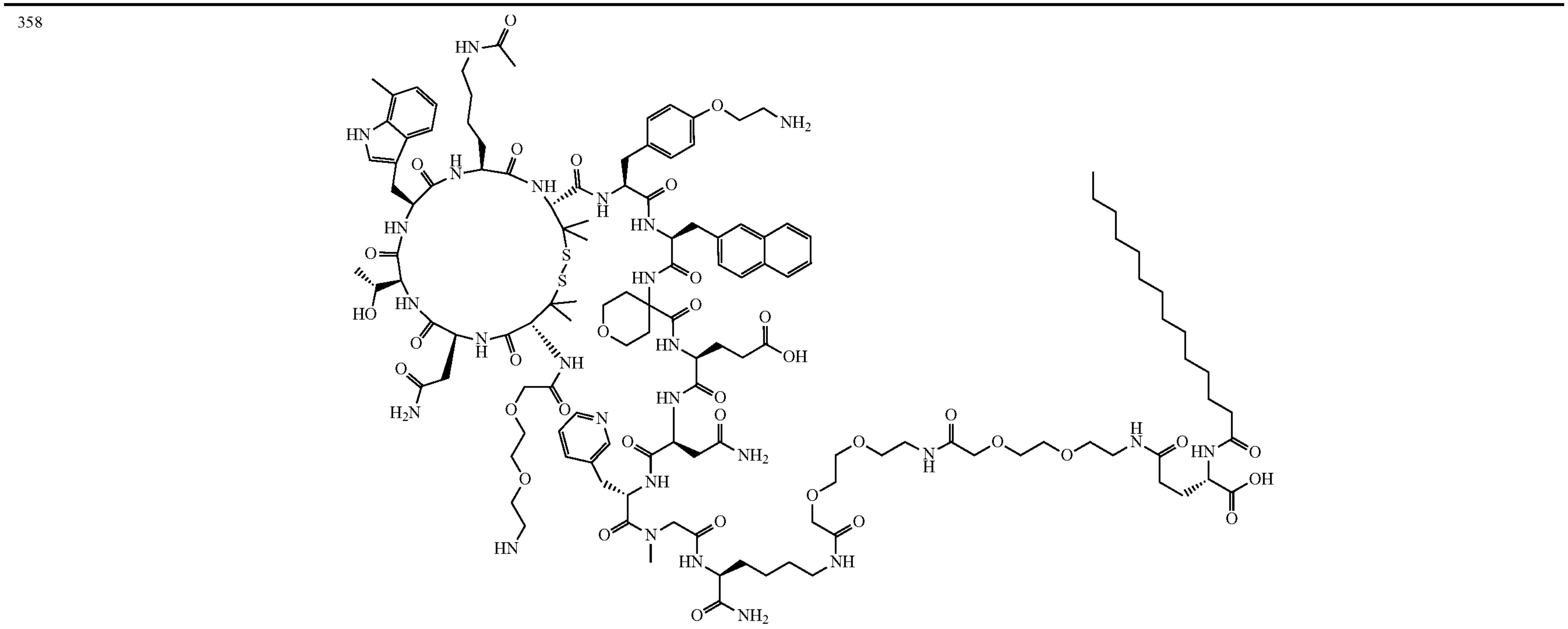 |

TABLE 1M-continued

| Compounds. | |
| --- | --- |
| SEQ ID | Structure<br>Peptide Sequence<br>Smiles |
| | 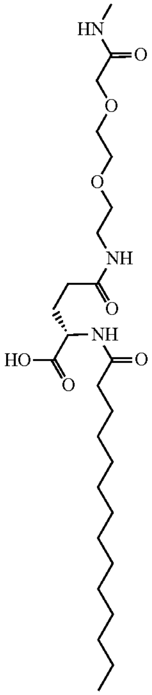<br>C14gEPEG2PEG2CO-Pen(3)-N-T-7MeW-K(Ac)-Pen(3)-AEF-2Nal-THP-E-N-3Pya-Sar-K(PEG2PEG2gEC14)-CONH2<br>CCCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(COCCOCCNC(COCCOCCNC(CC[C@@H](C(O)=O)NC(CCCCCCCCCCCCC)=O)=O)=O)=O)=O)=O)=O)C(O)=O)=O)=O |

TABLE 1M-continued
| Compounds. | |
|---|---|
| SEQ ID | Structure<br>Peptide Sequence<br>Smiles |
| 359 | 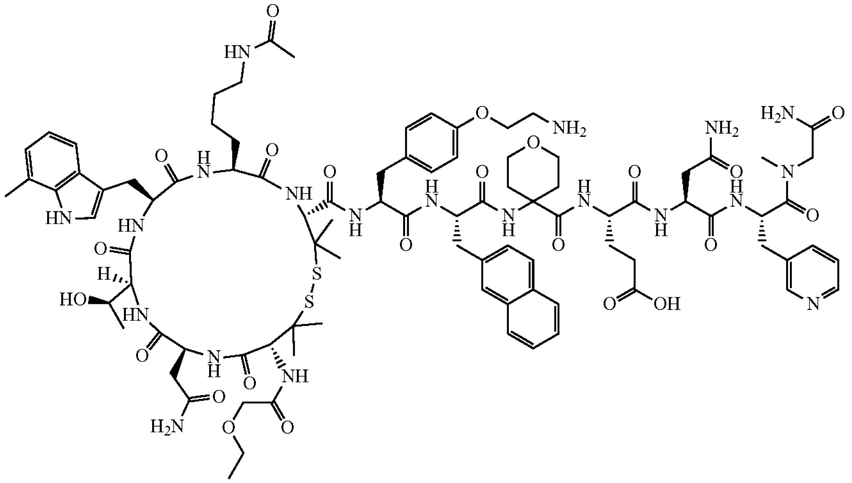 |

TABLE 1M-continued

| SEQ ID | Compounds. Structure Peptide Sequence Smiles |
|---|---|
| | 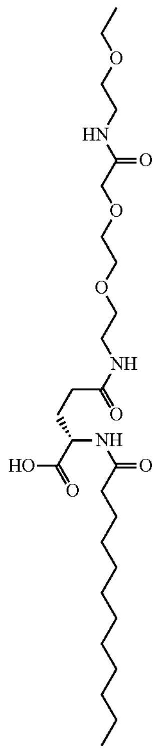<br>C12gEPEG2PEG2CO-Pen(3)-N-T-7MeW-K(Ac)-Pen(3)-AEF-2Nal-THP-E-N-3Pya-Sar-CONH2<br>CCCCCCCCCCCC(N[C@@H](CCC(NCCOCCOCC(NCCOCCOCC(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)C(O)=O)=O |

TABLE 1M-continued
| Compounds. | |
|---|---|
| SEQ ID | Structure<br>Peptide Sequence<br>Smiles |
| 360 | 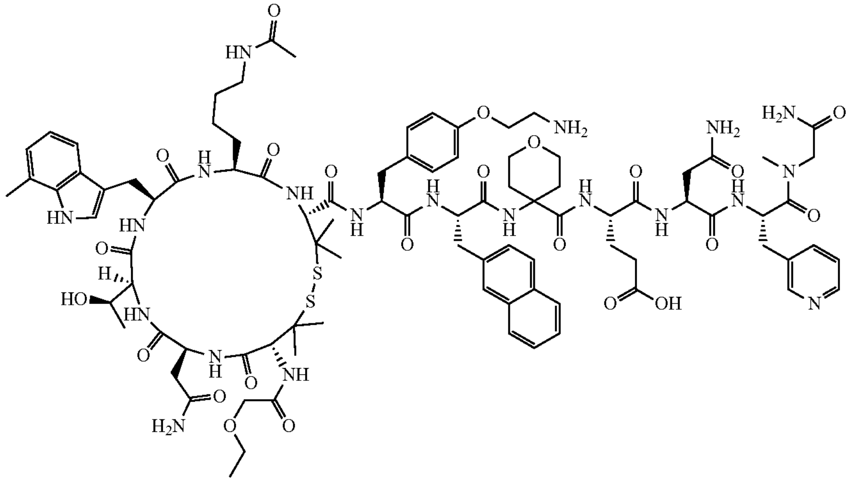 |

TABLE 1M-continued

| Compounds. | |
|---|---|
| SEQ ID | Structure<br>Peptide Sequence<br>Smiles |
| | 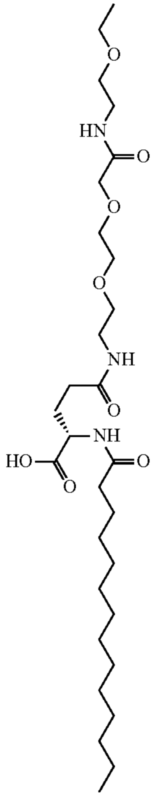<br>C14gEPEG2PEG2CO-Pen(3)-N-T-7MeW-K(Ac)-Pen(3)-AEF-2Nal-THP-E-N-3Pya-Sar-CONH2<br>CCCCCCCCCCCCCC(N[C@@H](CCC(NCCOCCOCC(NCCOCCOCC(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)C(O)=O)=O |

TABLE 1M-continued
| Compounds. | |
|---|---|
| SEQ ID | Structure<br>Peptide Sequence<br>Smiles |
| 361 | 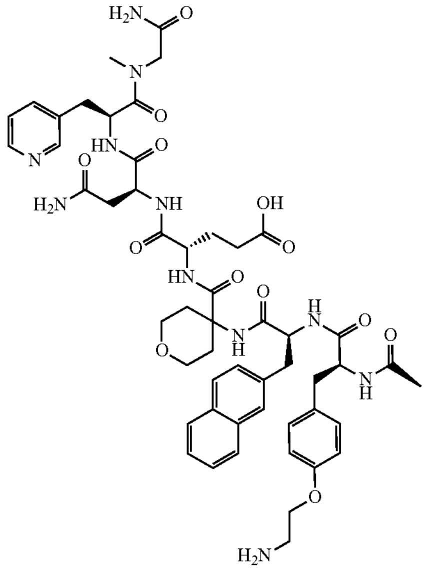 |

TABLE 1M-continued
| Compounds. | |
|---|---|
| SEQ ID | Structure<br>Peptide Sequence<br>Smiles |
| | 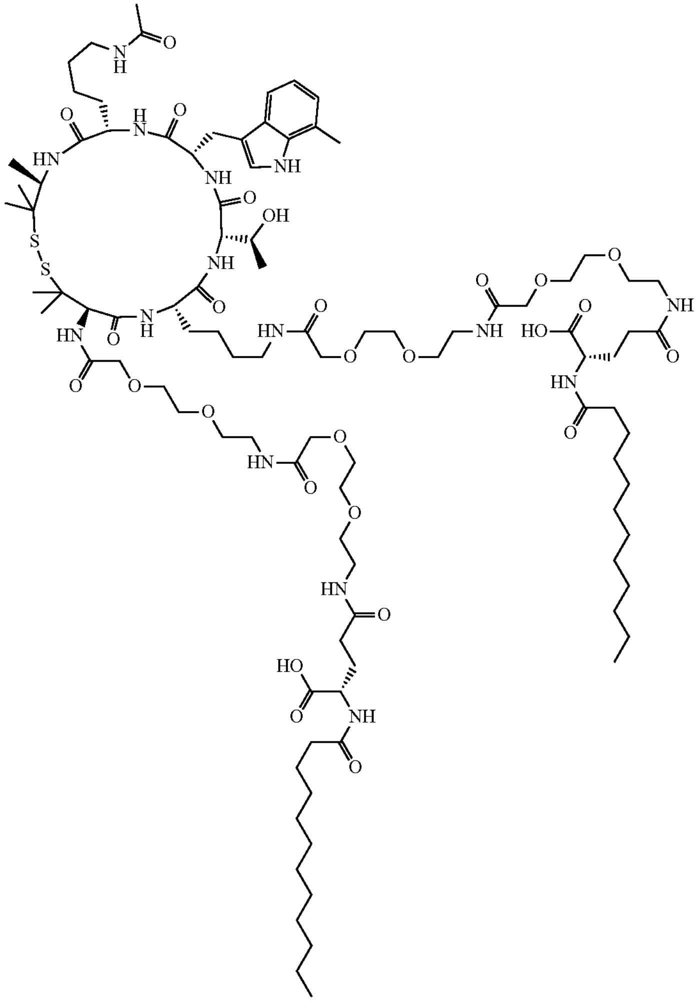 |

TABLE 1M-continued

| SEQ ID | Compounds. Structure Peptide Sequence Smiles |
|---|---|
| 362 | C12gEPEG2PEG2CO-Pen(3)-K(PEG2PEG2gEC12)-T-7MeW-K(Ac)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(COCCOCCNC(COCCOCCNC(CC[C@@H](C(O)=O)NC(CCCCCCCCCCCC)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)=O)=O)=O)C(O)=O)=O<br>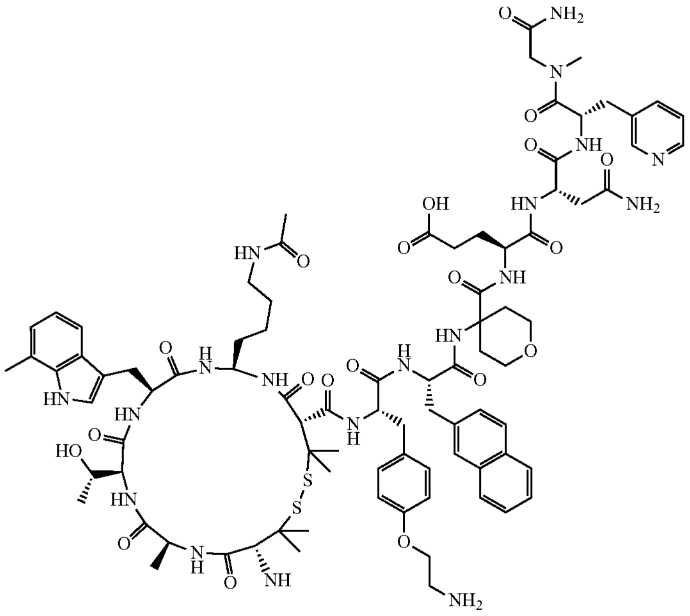 |

TABLE 1M-continued

| Compounds. | |
|---|---|
| SEQ ID | Structure<br>Peptide Sequence<br>Smiles |
| | 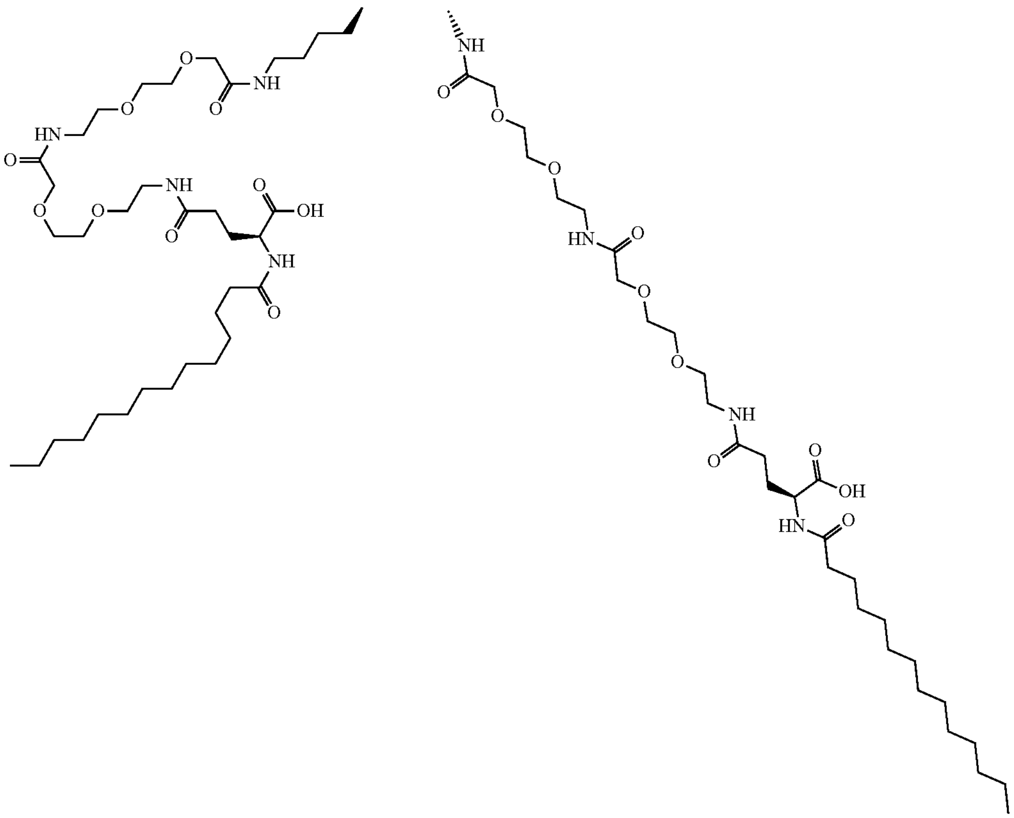<br>C14gEPEG2PEG2CO-Pen(3)-K(PEG2PEG2gEC14)-T-7MeW-K(Ac)-Pen(3)-AEF-2Nal-THP-E-N-3Pya-Sar-CONH2<br>CCCCCCCCCCCCCC(N[C@@H](CCC(NCCOCCOCC(NCCOCCOCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(COCCOCCNC(COCCOCCNC(CC[C@@H](C(O)=O)NC(CCCCCCCCCCCCCC)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc |

TABLE 1M-continued
| Compounds. | |
|---|---|
| SEQ ID | Structure<br>Peptide Sequence<br>Smiles |
| | 2)C(N(C)CC(N)=O)=O)=O)=O)=O)=O)=O)=O)=O)=O)=O)=O)=O)NC1=O)=O)=O)=O)<br>C(O)=O)=O |
| 363 | 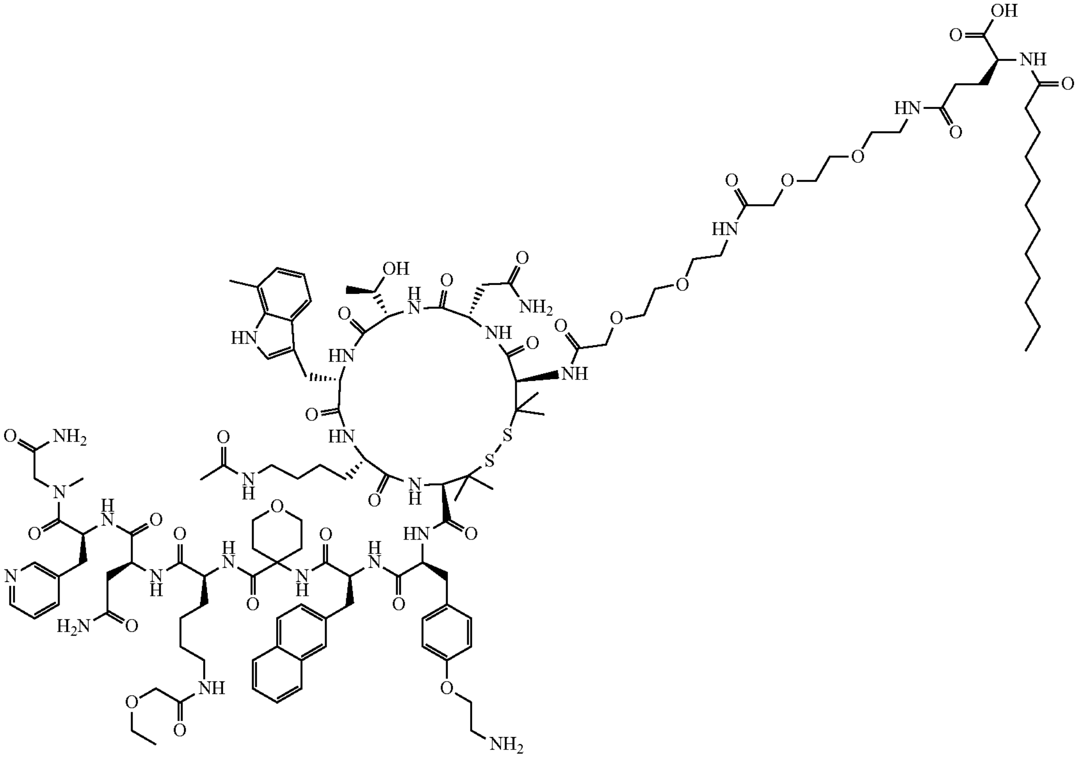 |

TABLE 1M-continued

| Compounds. | |
|---|---|
| SEQ ID | Structure<br>Peptide Sequence<br>Smiles |
| | 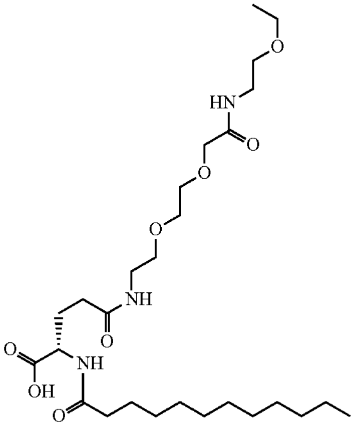<br>C12gEPEG2PEG2CO-Pen(3)-N-T-7MeW-K(Ac)-Pen(3)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(COCCOCCNC(COCCOCCNC(CC[C@@H](C(O)=O)NC(CCCCCCCCCCC)=O)=O)=O)=O)NC1=O)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 364 | 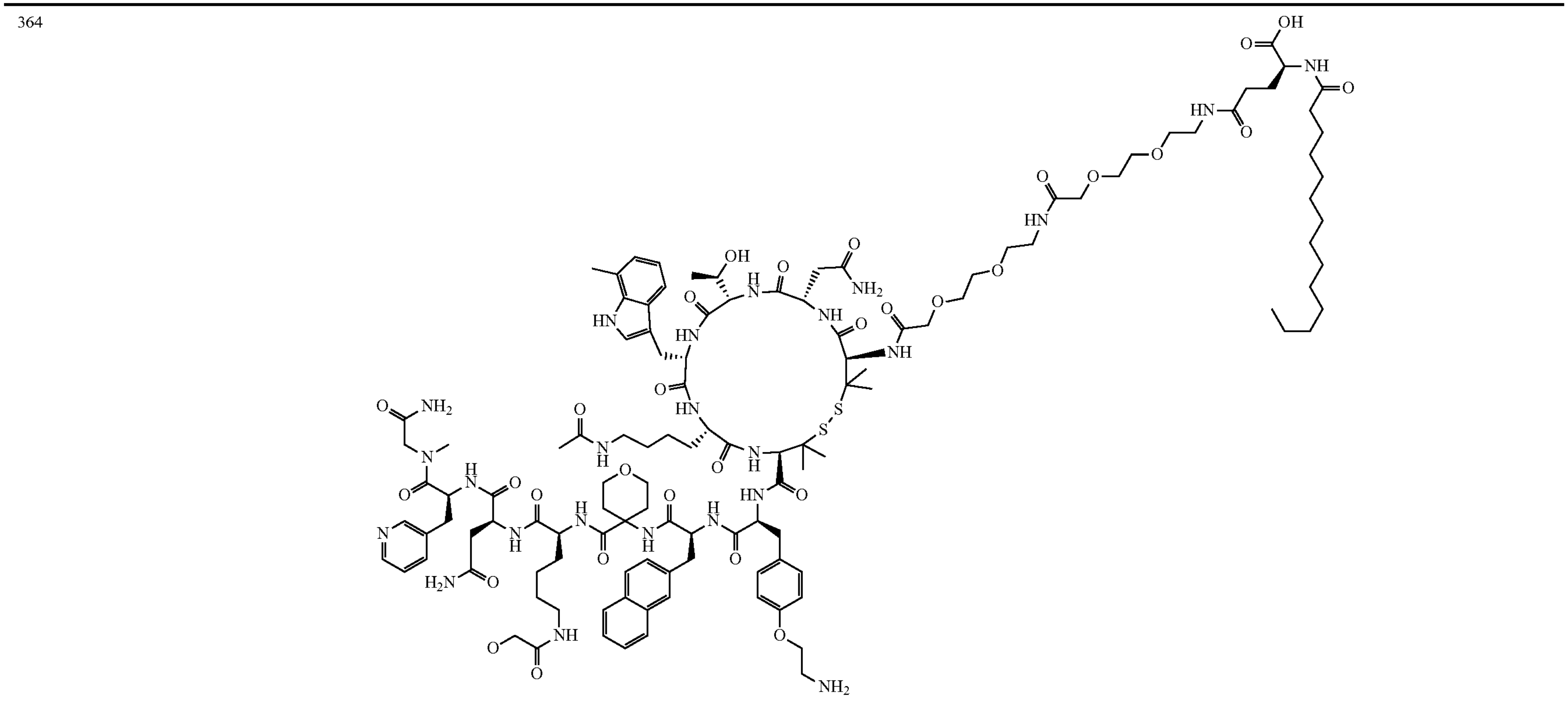 |

TABLE 1M-continued

| Compounds. | |
|---|---|
| SEQ ID | Structure<br>Peptide Sequence<br>Smiles |
| | 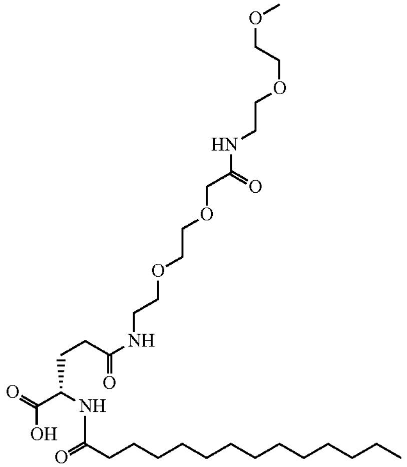<br>C14gEPEG2PEG2CO-Pen(3)-N-T-7MeW-K(Ac)-Pen(3)-AEF-2Nal-THP-K(PEG2PEG2gEC14)-N-3Pya-Sar-CONH2<br>CCCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc10CCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(COCCOCCNC(COCCOCCNC(CC[C@@H](C(O)=O)NC(CCCCCCCCCCCCC)=O)=O)=O)=O)NC1=O)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 365 | 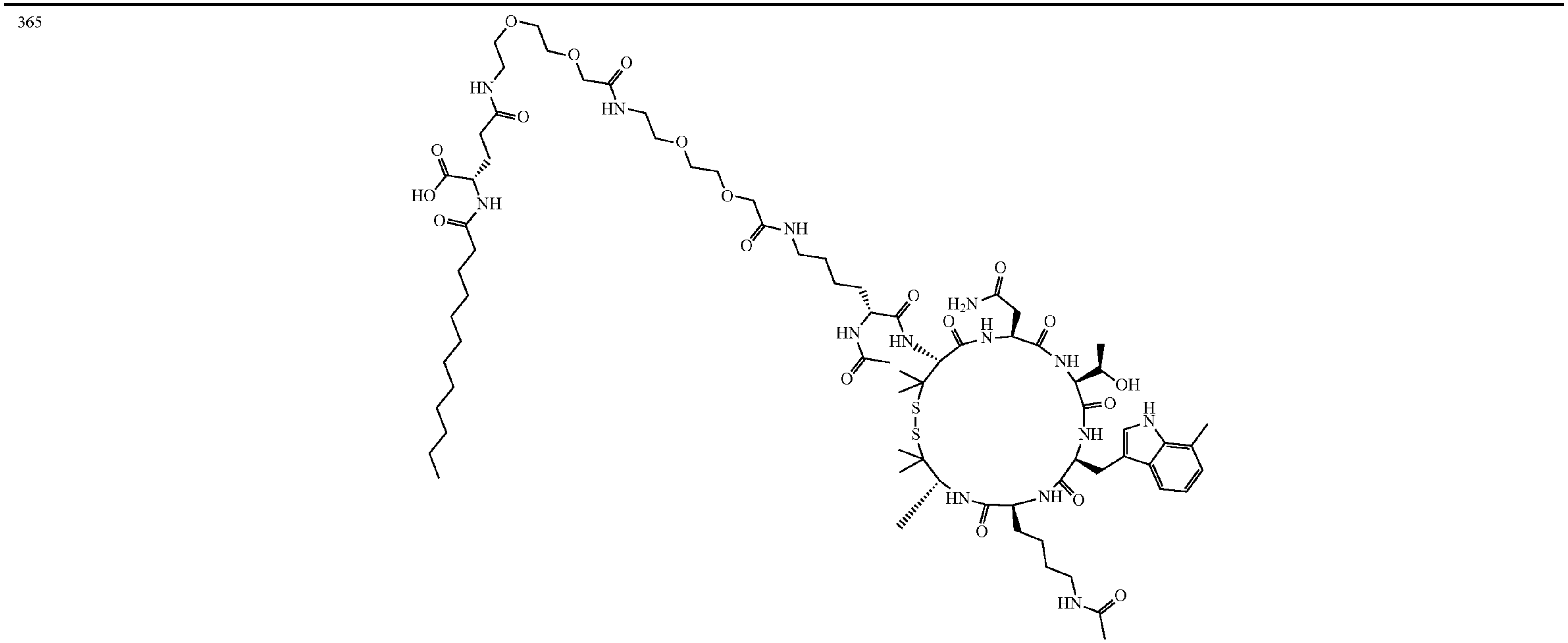 |

TABLE 1M-continued

| SEQ ID | Compounds. Structure Peptide Sequence Smiles |
|---|---|
| | 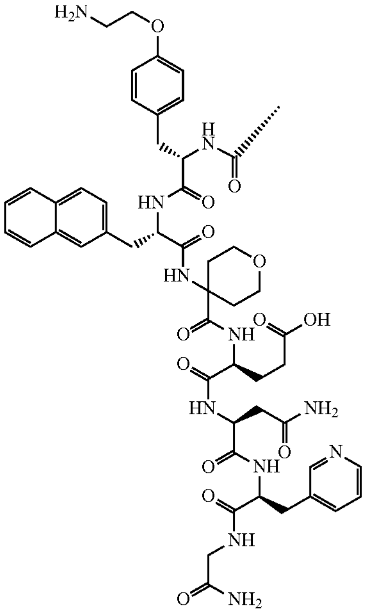 MeCO-k(PEG2PEG2gEC12)-Pen(3)-N-T-7MeW-K(Ac)-Pen(3)-AEF-2Nal-THP-E-N-3Pya-Sar-CONH2 CCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(C)=O)=O)=O)=O)C(O)=O)=O)=O |

TABLE 1M-continued
| Compounds. | |
|---|---|
| SEQ ID | Structure<br>Peptide Sequence<br>Smiles |
| 366 | 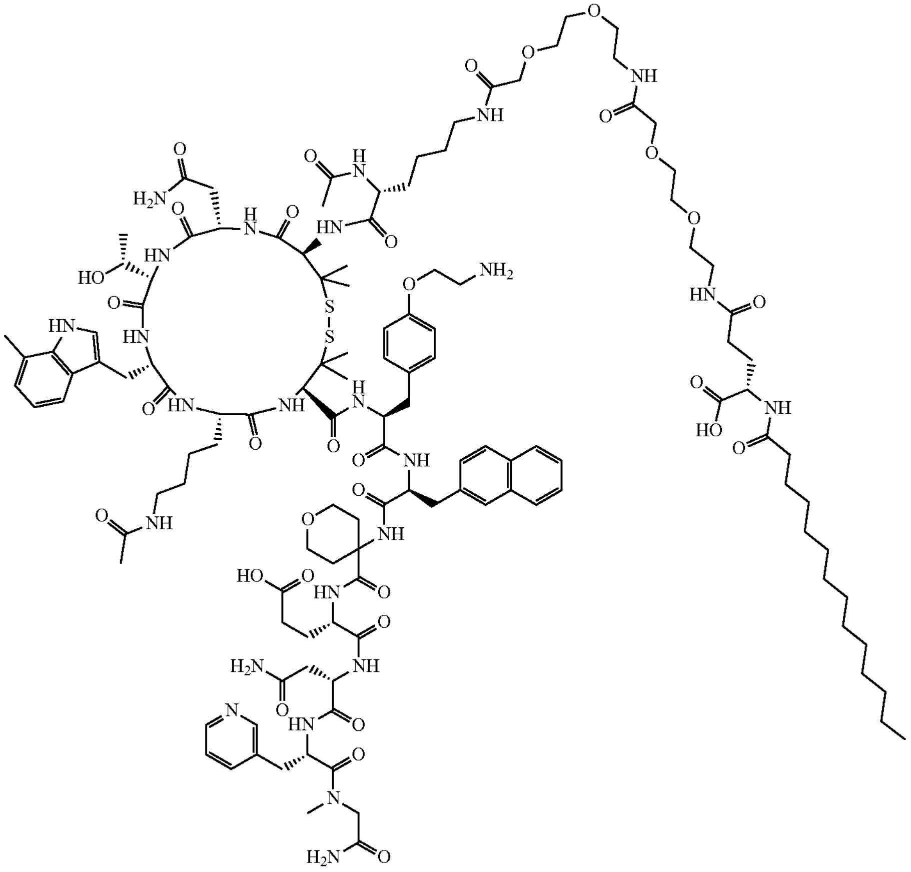 [SMILES: CCCCCCCCCCCCCC(=O)N[C@@H](CCC(=O)NCCOCCOCC(=O)NCCOCCOCC(=O)NCCCC[C@@H](NC(C)=O)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>MeCO-k(PEG2PEG2gEC14)-Pen(3)-N-T-7MeW-K(Ac)-Pen(3)-AEF-2Nal-THP-E-N-3Pya-Sar-CONH2<br>CCCCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C |

TABLE 1M-continued
| Compounds. | |
|---|---|
| SEQ ID | Structure<br>Peptide Sequence<br>Smiles |
| 367 | (N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(C)=O)=O)=O)=O)C(O)=O)=O<br>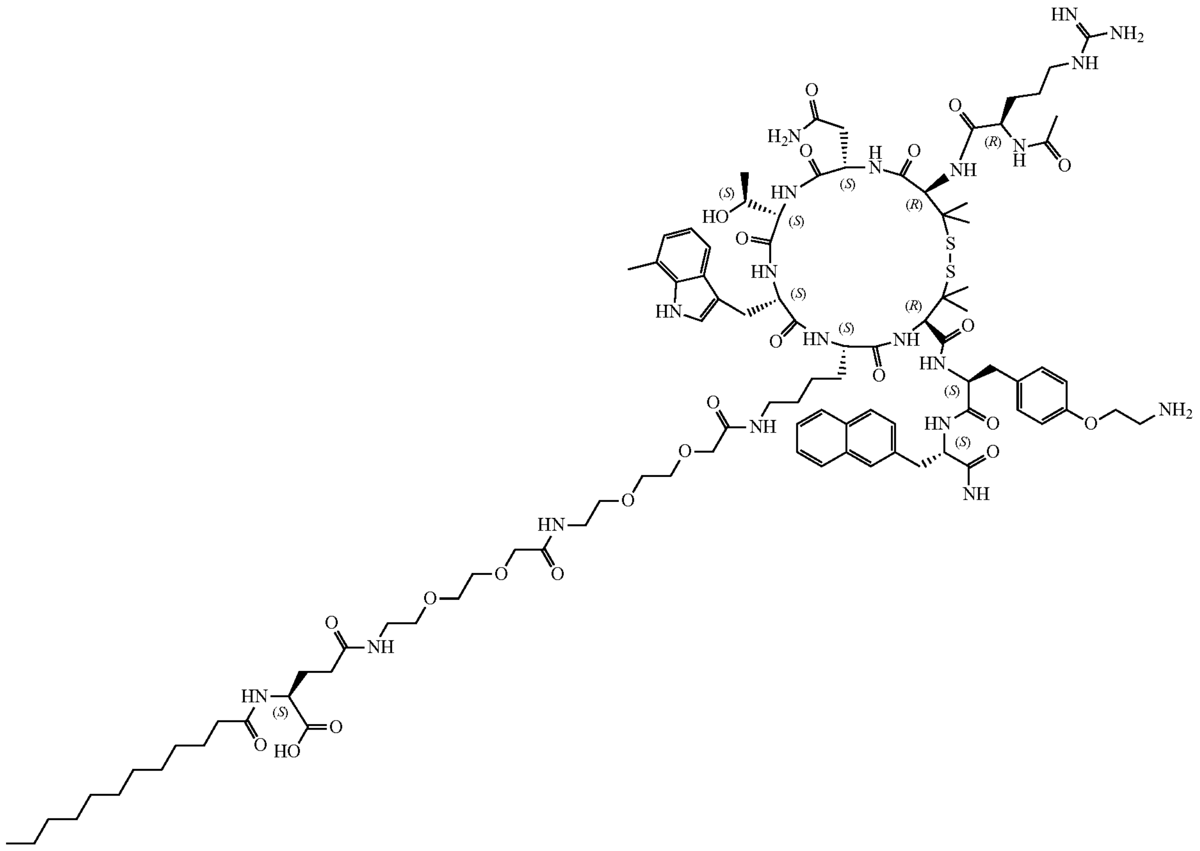 |

TABLE 1M-continued
| SEQ ID | Compounds. Structure Peptide Sequence Smiles |
|---|---|
| | 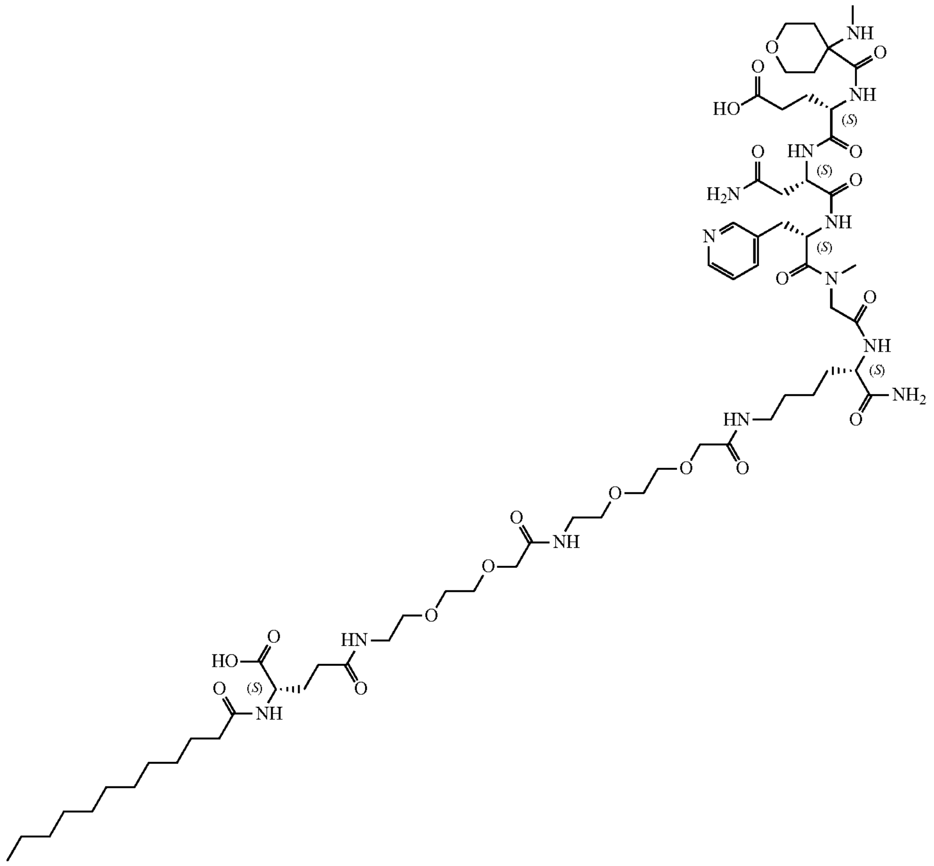 MeCO-r-Pen(3)-N-T-7MeW-K(PEG2PEG2gEC12)-Pen(3)-AEF-2Nal-THP-E-N-3Pya-Sar-K(PEG2PEG2gEC12)-CONH2 CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C |

TABLE 1M-continued
| Compounds. | |
|---|---|
| SEQ ID | Structure<br>Peptide Sequence<br>Smiles |
| | @@H]([C@@H](C)O)C(N[C@@H](Cc1c[nH]c2c1cccc2C)C(N[C@H]1CCCCNC(COCCOCCNC(COCCOCCNC(CC[C@@H](C(O)=O)NC(CCCCCCCCCCC)=O)=O)=O)=O)=O)=O)=O)=O)NC([C@@H](CCCNC(N)=N)NC(C)=O)=O)NC1=O)=O)=O)=O)=O)=O)=O)=O)=O)=O)=O)=O)C(O)=O)=O |
| 368 | 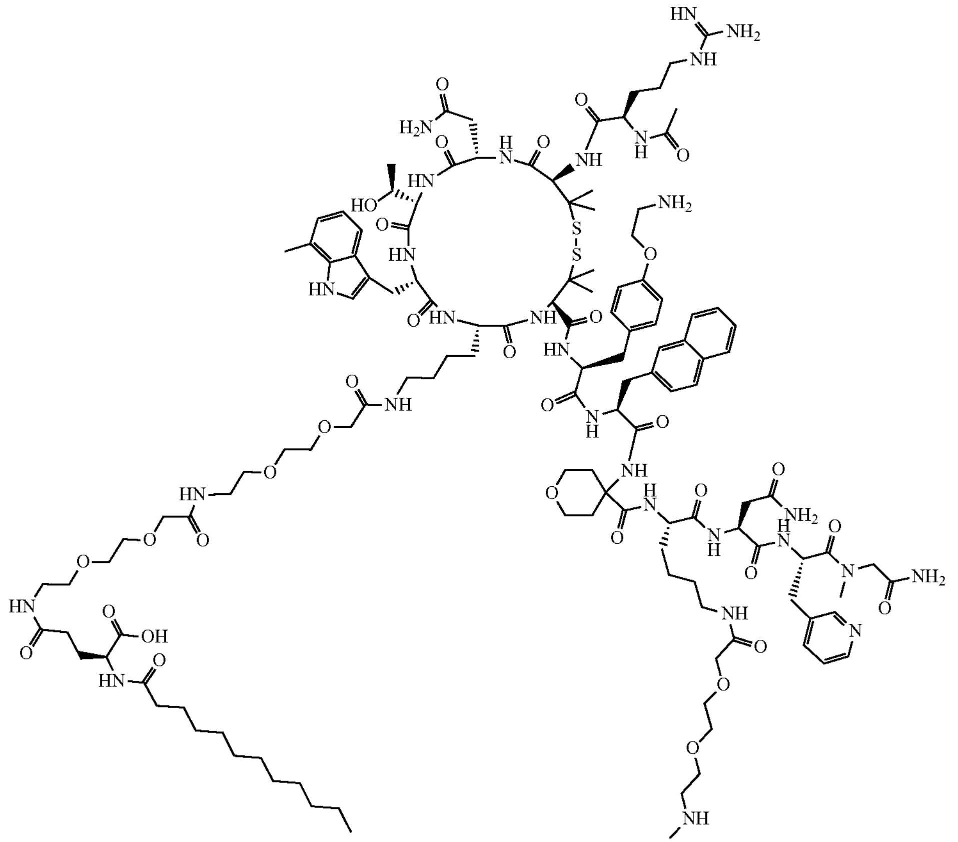 |

TABLE 1M-continued

| Compounds. | |
|---|---|
| SEQ ID | Structure<br>Peptide Sequence<br>Smiles |
| | 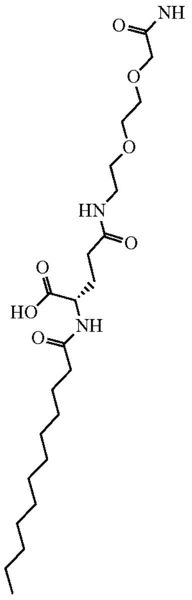<br>MeCO-r-Pen(3)-N-T-7MeW-K(PEG2PEG2gEC12)-Pen(3)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(COCCOCCNC(COCCOCCNC(CC[C@@H](C(O)=O)NC(CCCCCCCCCCC)=O)=O)=O)=O)=O)=O)=O)=O)NC([C@@H](CCCNC(N)=N)NC(C)=O)=O)NC1=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 369 | 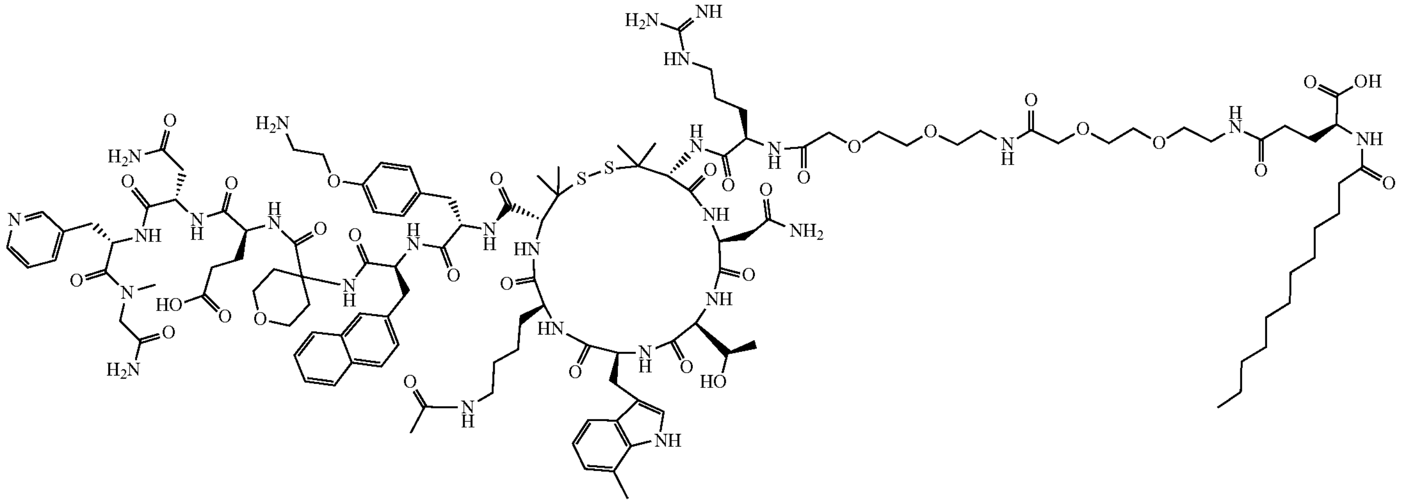<br>C12gEPEG2PEG2CO-r-Pen(3)-N-T-7MeW-K(Ac)-Pen(3)-AEF-2Nal-THP-E-N-3Pya-Sar-CONH2<br>CCCCCCCCCCCC(N[C@@H](CCC(NCCOCCOCC(NCCOCCOCC(N[C@H](CCCNC(N)=N)C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)=O)C(O)=O)=O |

TABLE 1M-continued
| Compounds. | |
| --- | --- |
| SEQ ID | Structure<br>Peptide Sequence<br>Smiles |
| 370 | 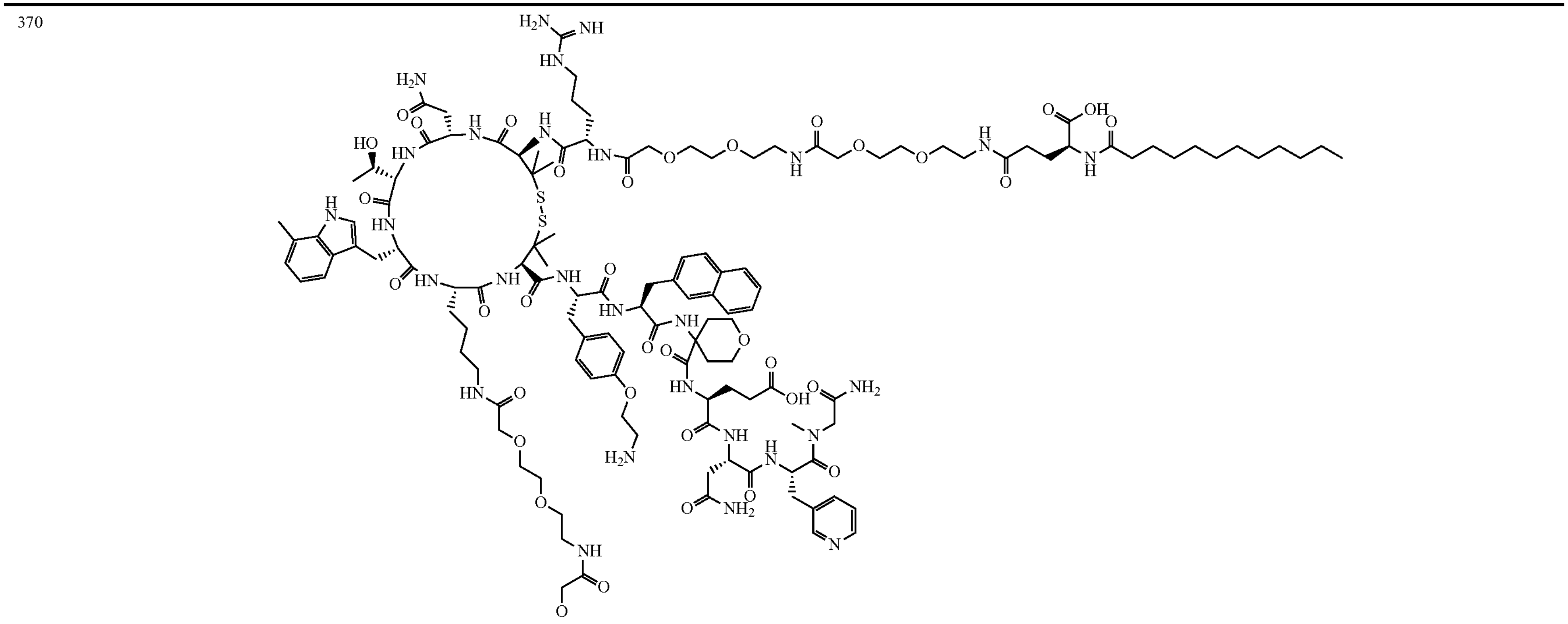 |

TABLE 1M-continued

| SEQ ID | Compounds. Structure Peptide Sequence Smiles |
|---|---|
| | 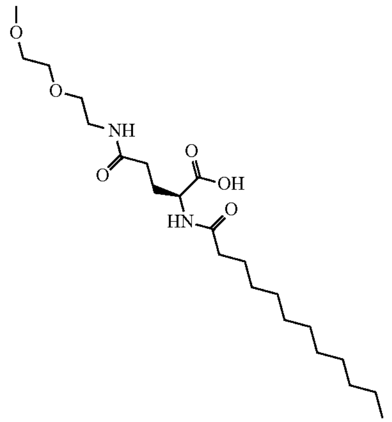<br>C12gEPEG2PEG2CO-r-Pen(3)-N-T-7MeW-K(PEG2PEG2gEC12)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC([C@@H](CCCNC(N)=N)NC(COCCOCCNC(COCCOCCNC(CC[C@@H](C(O)=O)NC(CCCCCCCCCCC)=O)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued

| SEQ ID | Compounds. Structure Peptide Sequence Smiles |
|---|---|
| 371 | 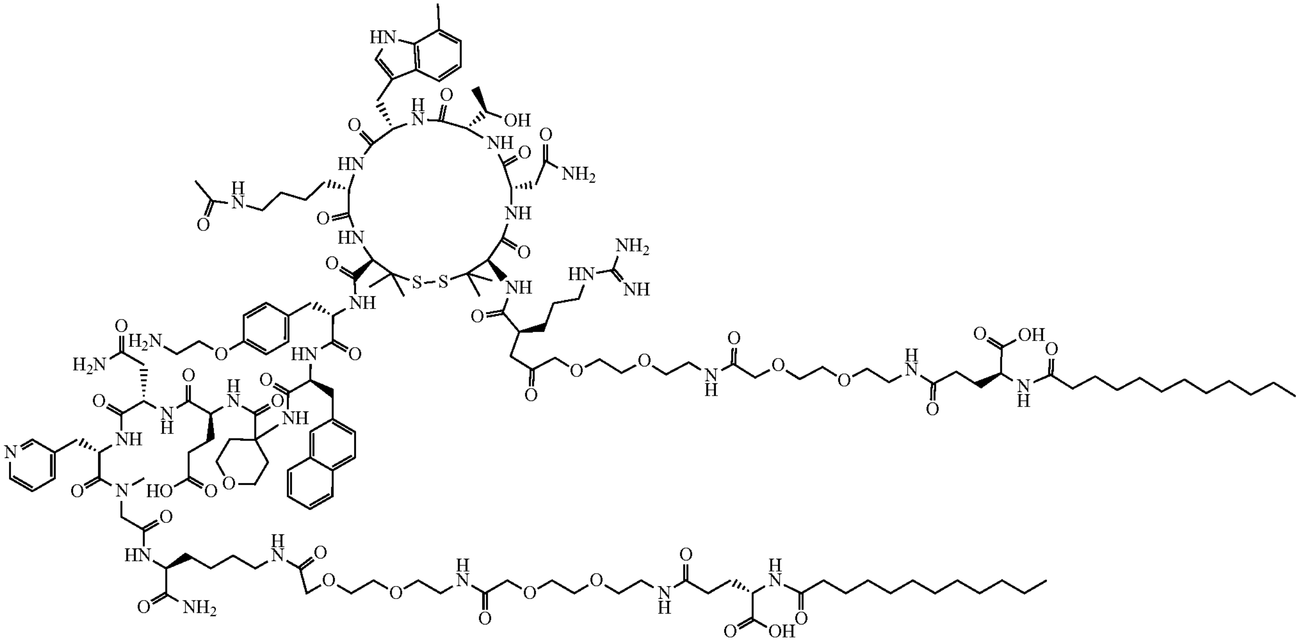 [SMILES: CCCCCCCCCCCC(=O)N[C@@H](CCC(=O)NCCOCCOCC(=O)NCCOCCOCC(=O)C[C@H](CCCNC(=N)N)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(=O)N[C@@H](CCCCNC(=O)COCCOCCNC(=O)COCCOCCNC(=O)CC[C@H](NC(=O)CCCCCCCCCCC)C(=O)O)C(N)=O)CCOCC2)C(C)(C)SSC1(C)C)C(=O)O]<br>C12gEPEG2PEG2CO-r-Pen(3)-N-T-7MeW-K(Ac)-Pen(3)-AEF-2Nal-THP-E-N-3Pya-Sar-K(PEG2PEG2gEC12)-CONH2<br>CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)=O)NC([C@@H](CCCNC(N)=N)NC(COCCOCCNC(COCCOCCNC(CC[C@@H](C(O)=O)NC(CCCCCCCCCCC)=O)=O)=O)=O)=O)NC1=O)=O)=O)=O)=O)=O)=O)=O)=O)=O)=O)=O)C(O)=O)=O)=O |

TABLE 1M-continued

| Compounds. | |
|---|---|
| SEQ ID | Structure<br>Peptide Sequence<br>Smiles |
| 372 | 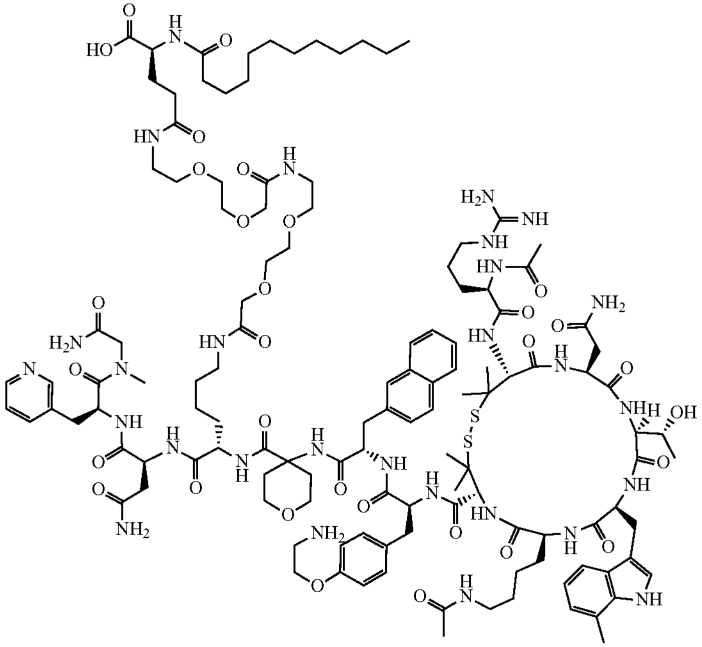 [SMILES: CCCCCCCCCCCC(=O)N[C@@H](CCC(=O)NCCOCCOCC(=O)NCCOCCOCC(=O)NCCCC[C@H](NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(=O)[C@@H](CCCNC(=N)N)NC(C)=O)C(C)(C)SSC2(C)C)CCOCC1)C(=O)N[C@@H](CC(N)=O)C(=O)N[C@@H](Cc1cccnc1)C(=O)N(C)CC(N)=O)C(=O)O]<br>MeCO-r-Pen(3)-N-T-7MeW-K(Ac)-Pen(3)-AEF-2Nal-THP-K(PEG2PEG2gEC12)-N-3Pya-Sar-CONH2<br>CCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC([C@@H](CCCNC(N)-N)NC(C)=O)=O)NC1=O)=O)=O)=O)=O)=O)=O)=O)C(O)=O)=O)=O |

TABLE 1M-continued

Compounds.

| SEQ ID | Structure<br>Peptide Sequence<br>Smiles |
|---|---|
| 373 | 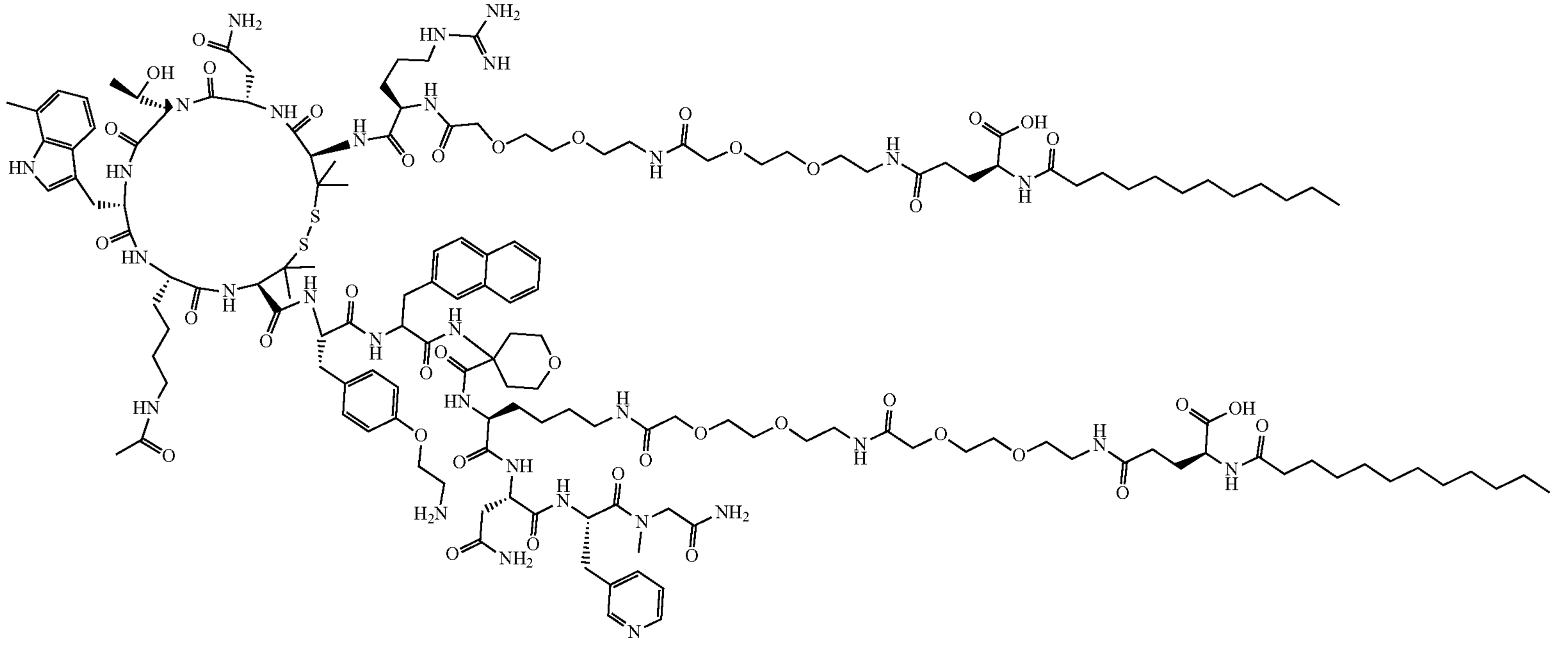<br>C12gEPEG2PEG2CO-r-Pen(3)-N-T-7MeW-K(Ac)-Pen(3)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC([C@@H](CCCNC(N)=N)NC(COCCOCCNC(COCCOCCNC(CC[C@@H](C(O)=O)NC(CCCCCCCCCCC)=O)=O)=O)=O)=O)NC1=O)=O)=O)=O)=O)=O)=O)=O)C(O)=O)=O |

TABLE 1M-continued

| SEQ ID | Compounds. Structure Peptide Sequence Smiles |
|---|---|
| 374 | 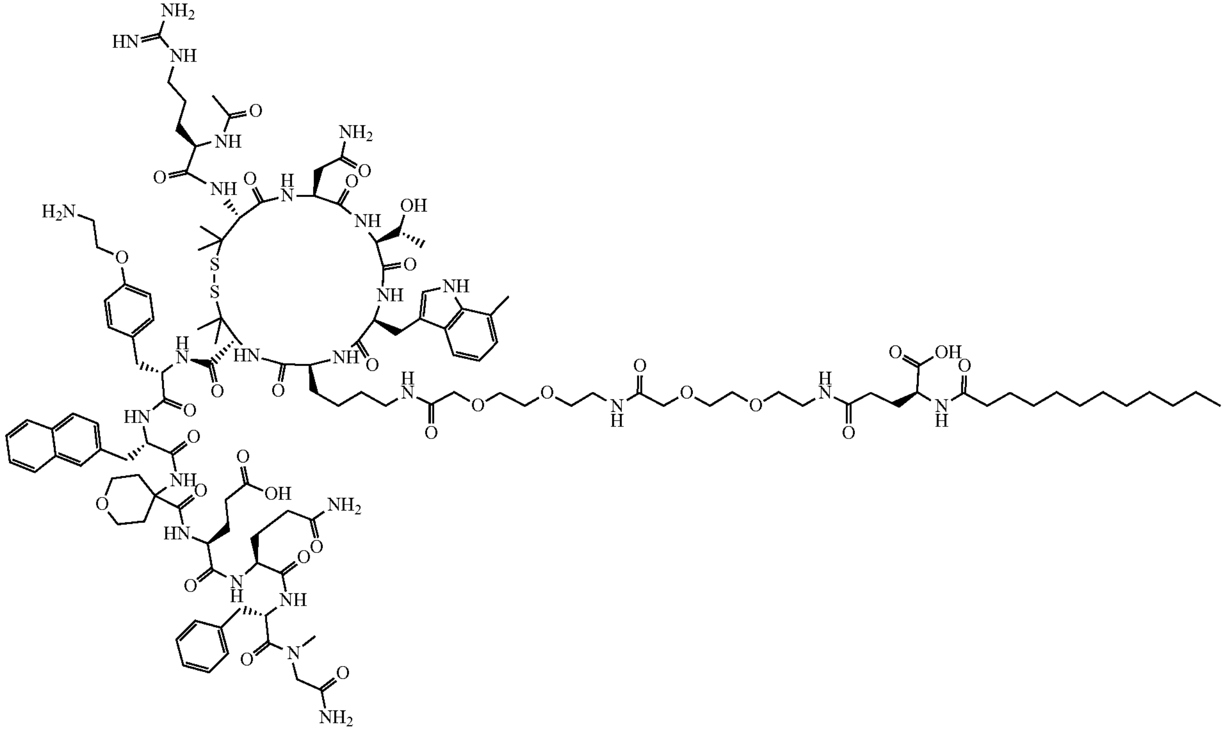 MeCO-r-Pen(3)-N-T-7MeW-K(PEG2PEG2gEC12)-Pen(3)-AEF-2Nal-THP-E-N-3Pya-Sar-CONH2 CCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued

| SEQ ID | Compounds. Structure Peptide Sequence Smiles |
|---|---|
| 375 | 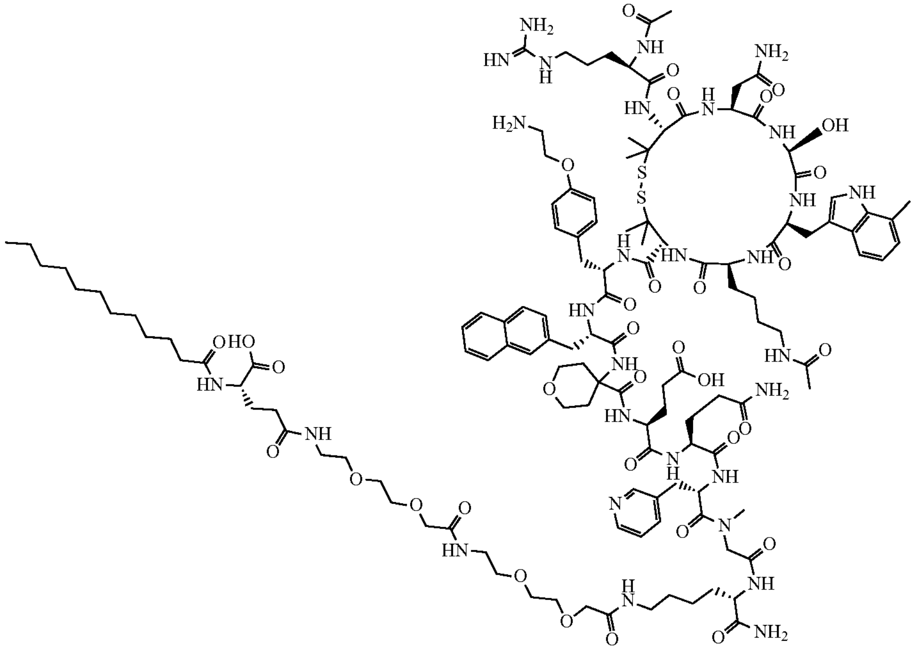 [SMILES: CCCCCCCCCCCC(=O)N[C@@H](CCC(=O)NCCOCCOCC(=O)NCCOCCOCC(=O)NCCCC[C@H](NC(=O)CN(C)C(=O)[C@H](Cc1cccnc1)NC(=O)[C@H](CCC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H](O)NC(=O)[C@H](CC(N)=O)NC(=O)[C@@H](NC(=O)[C@@H](CCCNC(=N)N)NC(C)=O)C(C)(C)SSC2(C)C)CCOCC1)C(N)=O)C(=O)O]<br>MeCO-r-Pen(3)-N-T-7MeW-K(Ac)-Pen(3)-AEF-2Nal-THP-E-N-3Pya-Sar-K(PEG2PEG2gEC12)-CONH2<br>CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CCC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC([C@@H](CCCNC(N)=N)NC(C)=O)=O)NC1=O)=O)=O)=O)=O)=O)=O)=O)=O)=O)=O)=O)C(O)=O)=O |

TABLE 1M-continued

Compounds.

| SEQ ID | Structure<br>Peptide Sequence<br>Smiles |
|---|---|
| 376 | 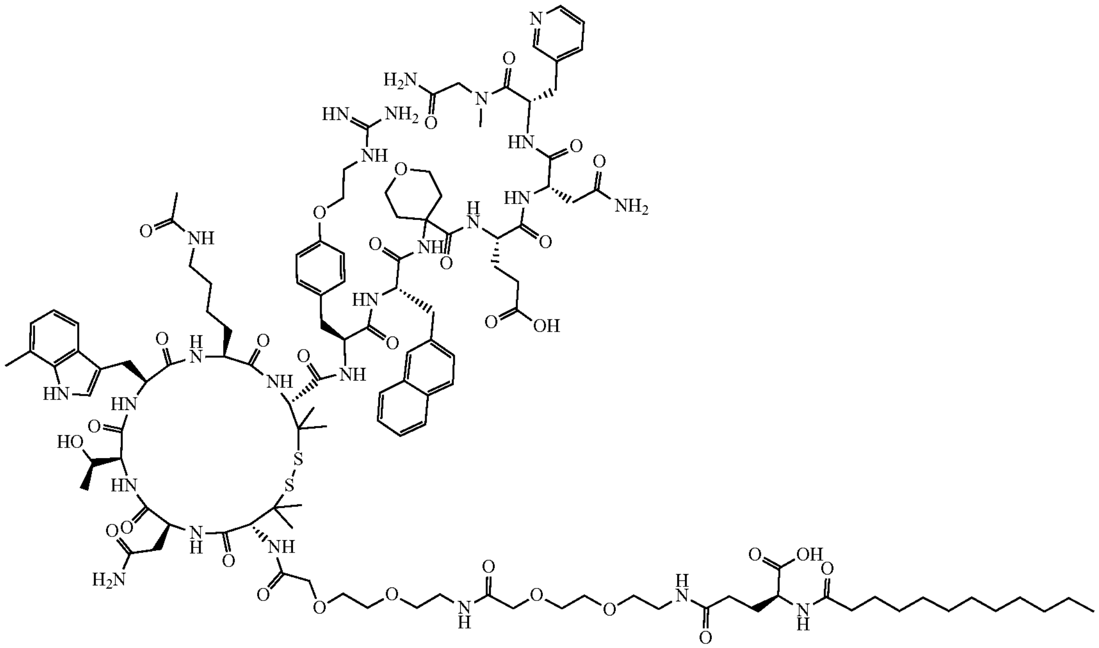 [SMILES: CCCCCCCCCCCC(=O)N[C@@H](CCC(=O)NCCOCCOCC(=O)NCCOCCOCC(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCNC(=N)N)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>C12gEPEG2PEG2CO-Pen(3)-N-T-7MeW-K(Ac)-Pen(3)-AEF(G)-2Nal-THP-E-N-3Pya-Sar-CONH2<br>CCCCCCCCCCCC(N[C@@H](CCC(NCCOCCOCC(NCCOCCOCC(N[C@@H](C(C)(C)SSC(C)(C)[C@@H](C(N[C@@H](Cc(cc1)ccc1OCCNC(N)=N)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)C(O)=O)=O |

TABLE 1M-continued
| Compounds. | |
|---|---|
| SEQ ID | Structure<br>Peptide Sequence<br>Smiles |
| 377 | 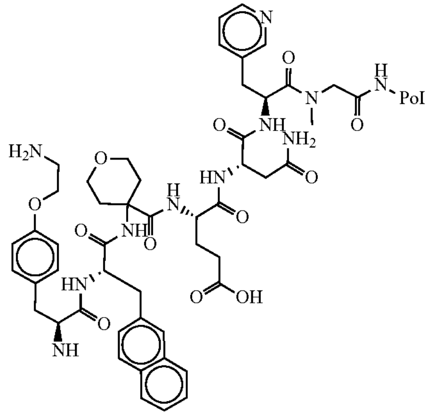 |

TABLE 1M-continued

| Compounds. | |
|---|---|
| SEQ ID | Structure<br>Peptide Sequence<br>Smiles |
| | 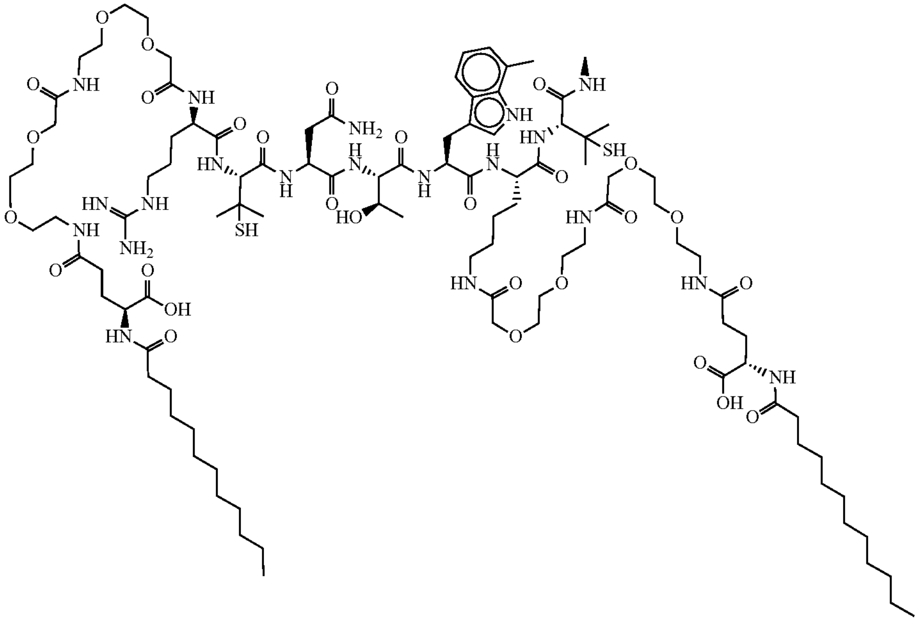<br>C12gEPEG2PEG2CO-r-Pen(3)-N-T-7MeW-K(PEG2PEG2gEC12)-Pen(3)-AEF-2Nal-THP-E-N-3Pya-Sar-CONH-resin<br>CCCCCCCCCCCC(N[C@@H](CCC(NCCOCCOCC(NCCOCCOCC(NCCCC[C@@H](C(N[C@@H](C(C)(C)S)C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N[Pol])=O)=O)=O)=O)=O)=O)=O)=O)=O)NC([C@H](Cc1c[nH]c2c1cccc2C)NC([C@H]([C@@H](C)O)NC([C@H](CC(N)=O)NC([C@H](C(C)(C)S)NC([C@@H](CCCNC(N)=N)NC(COCCOCCNC(COCCOCCNC(CC[C@@H](C(O)=O)NC(CCCCCCCCCCCC)=O)=O)=O)=O)=O)=O)=O)=O)=O)=O)=O)=O)C(O)=O)=O |

TABLE 1M-continued
| Compounds. | |
|---|---|
| SEQ ID | Structure<br>Peptide Sequence<br>Smiles |
| 378 | 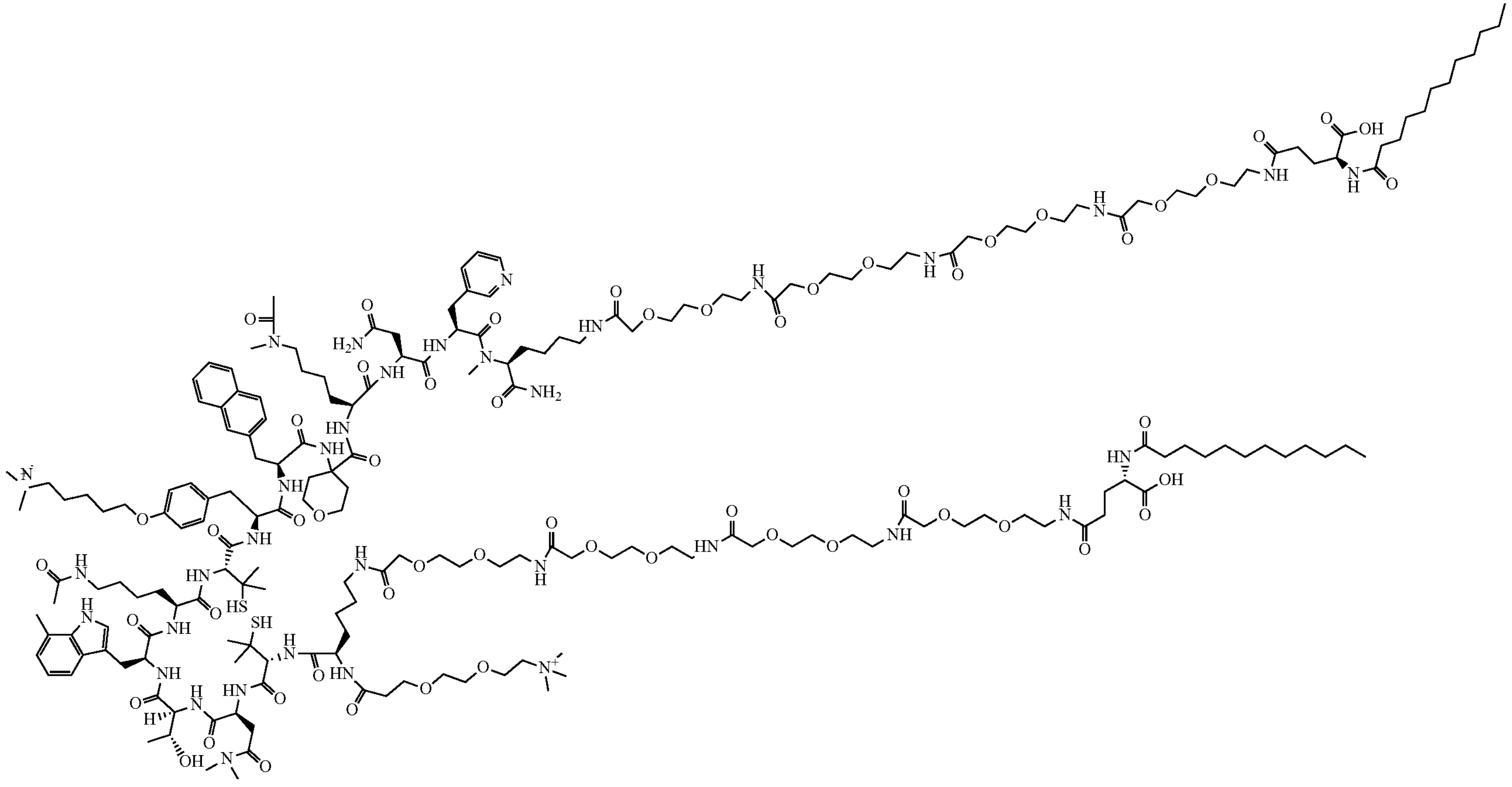<br>cPEG3aCO-k(PEG2PEG2PEG2PEG2gEC12)-Pen(3)-N(N(Me)2)-T-7MeW-K(Ac)-Pen(3)-TMAPF-2Nal-THP-K(NMeAc)-N-3Pya-NMeK(PEG2PEG2PEG2PEG2gEC12)-CONH2<br>CCCCCCCCCCCC(N[C@@H](CCC(NCCOCCOCC(NCCOCCOCC(NCCOCCOCC(NCCOCCOCC(NCCCC[C@H](C(N[C@@H](C(C)(C)S)C(N[C@@H](CC(N(C)C)=O)C(N[C@@H]([C@@H](C)O)C(N[C@@H](Cc1c[nH]c2c1cccc2C)C(N[C |

TABLE 1M-continued

| Compounds. | |
|---|---|
| SEQ ID | Structure<br>Peptide Sequence<br>Smiles |
| | @@H](CCCCNC(C)=O)C(N[C@@H](C(C)(C)S)C(N[C@@H](Cc(cc1)ccc1OCCC CC[N+](C)(C)C)C(N[C@@H](Cc1cc2ccccc2cc1)C(NC1(CCOCC1)C(N[C@@H] (CCCCN(C)C(C)=O)C(N[C@@H](CC(N)=O)C(N[C@@H](Cc1cnccc1)C(N(C)[C @@H](CCCCNC(COCCOCCNC(COCCOCCNC(COCCOCCNC(COCCOCCNC (CC[C@@H](C(O)=O)NC(CCCCCCCCCCCC)=O)=O)=O)=O)=O)=O)C(N)=O)=O)= O)=O)=O)=O)=O)=O)=O)=O)=O)=O)=O)NC(CCOCCOCC[N+](C)(C)C)=O)= O)=O)=O)=O)=O)C(O)=O)=O |
| 379 | 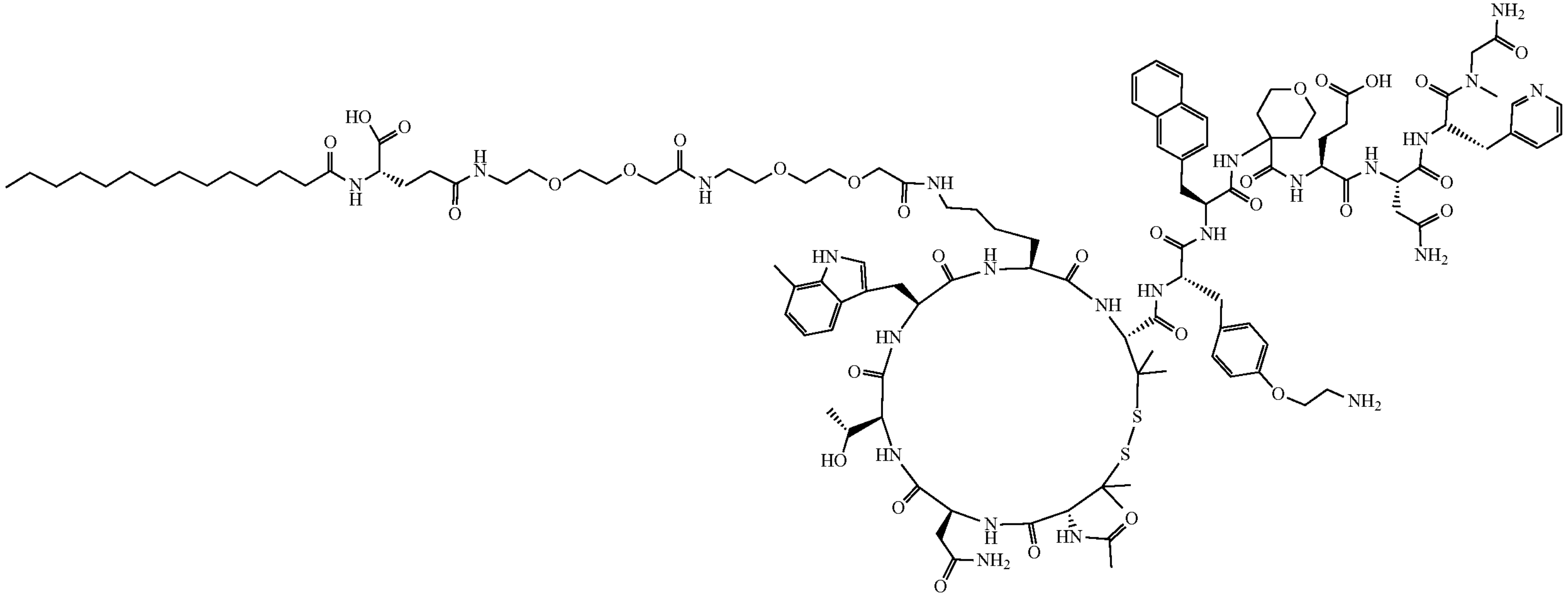<br>MeCO-Pen(3)-N-T-7MeW-K(PEG2PEG2gEC14)-Pen(3)-AEF-2Nal-THP-E-N-3Pya-Sar-CONH2<br>CCCCCCCCCCCCCCC(N[C@@H](CCC(NCCOCCOCC(NCCOCCOCC(NCCCC [C@@H](C(N[C@@H](C(C)(C)SSC(C)(C)[C@@H](C(N[C@@H](CC(N)=O)C(N [C@@H]([C@@H](C)O)C(N[C@H]1Cc2c[nH]c3c2cccc3C)=O)=O)=O)NC(C)=O) C(N[C@@H](Cc(cc2)ccc2OCCN)C(N[C@@H](Cc2cc3ccccc3cc2)C(NC2(CCOCC 2)C(N[C@@H](CCC(O)=O)C(N[C@@H](CC(N)=O)C(N[C@@H](Cc2cnccc2)C (N(C)CC(N)=O)=O)=O)=O)=O)=O)=O)=O)=O)=O)NC1=O)=O)=O)=O)C(O)=O)=O |

TABLE 1M-continued

| SEQ ID | Compounds. Structure Peptide Sequence Smiles |
|---|---|
| 380 | 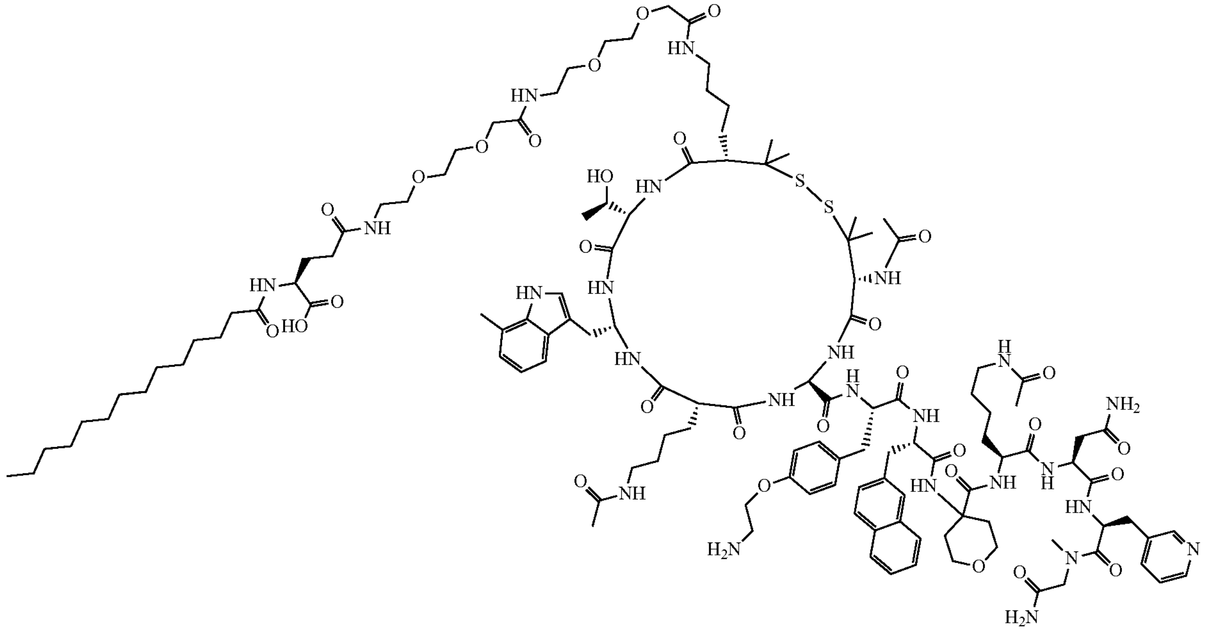 [SMILES: CCCCCCCCCCCCCC(=O)N[C@@H](CCC(=O)NCCOCCOCC(=O)NCCOCCOCC(=O)NCCCC[C@H]1C(=O)N[C@@H]([C@@H](C)O)C(=O)N[C@@H](Cc2c[nH]c3c(C)cccc23)NC(=O)[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC(=O)[C@@H](NC(C)=O)C(C)(C)SSC1(C)C)C(=O)O]<br>MeCO-Pen(3)-K(PEG2PEG2gEC14)-T-7MeW-K(Ac)-Pen(3)-AEF-2Nal-THP-K(Ac)-N-3Pya-Sar-CONH2<br>CCCCCCCCCCCCCC(N[C@@H](CCC(NCCOCCOCC(NCCOCCOCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(O)=O)=O |

TABLE 1M-continued

| SEQ ID | Compounds. Structure Peptide Sequence Smiles |
| --- | --- |
| 381 | 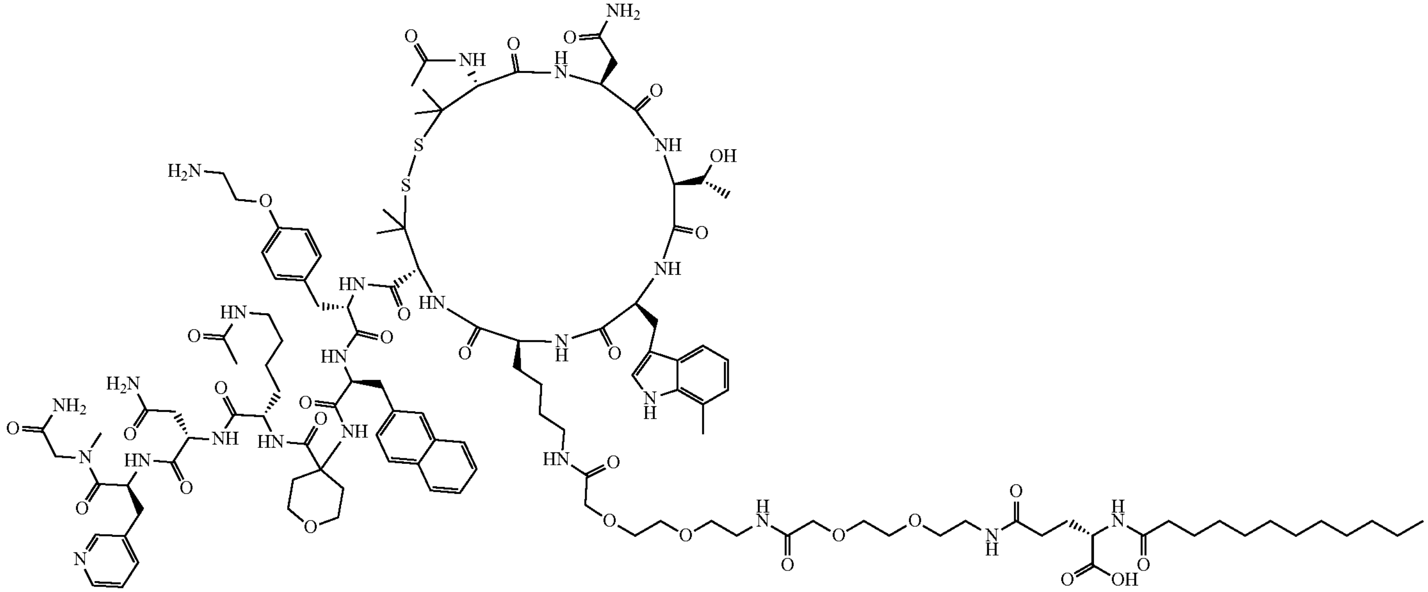 [SMILES: CCCCCCCCCCCC(=O)N[C@@H](CCC(=O)NCCOCCOCC(=O)NCCOCCOCC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC1=O)C(=O)O]<br>MeCO-Pen(3)-N-T-7MeW-K(PEG2PEG2gEC12)-Pen(3)-AEF-2Nal-THP-K(Ac)-N-3Pya-Sar-CONH2<br>CCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued

| Compounds. | |
|---|---|
| SEQ ID | Structure<br>Peptide Sequence<br>Smiles |
| 382 | 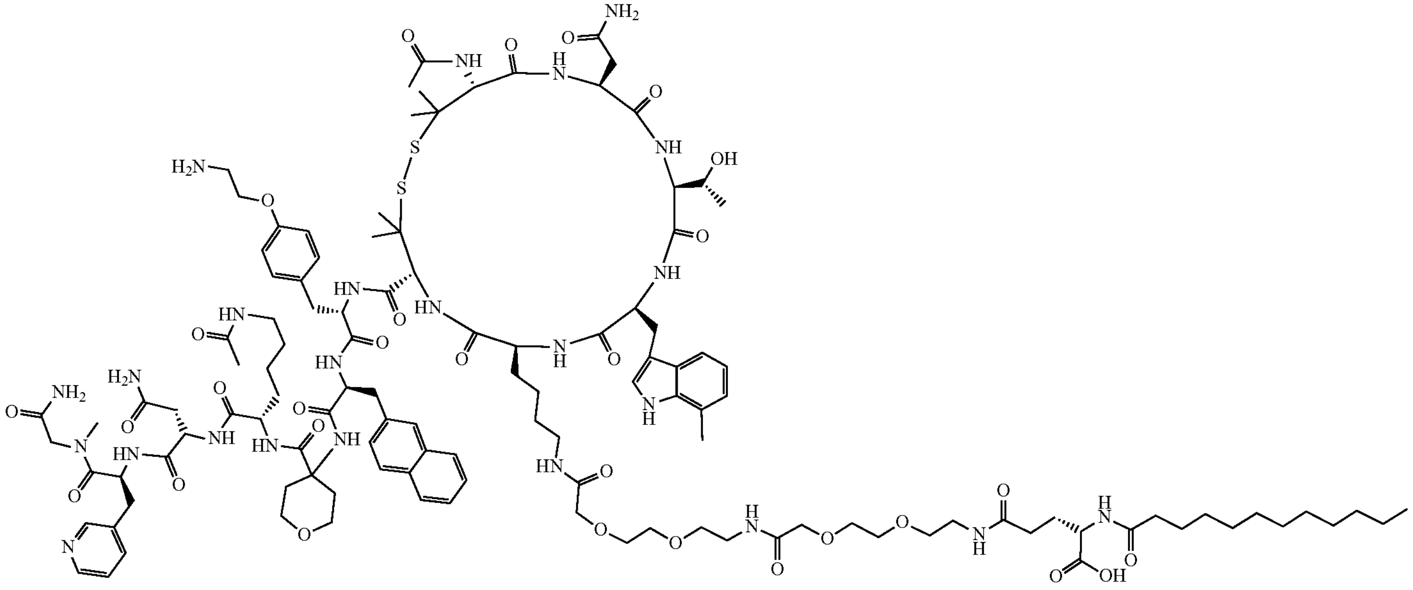<br>MeCO-Pen(3)-N-T-7MeW-Pen(3)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(C)=O)NC1=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 383 | 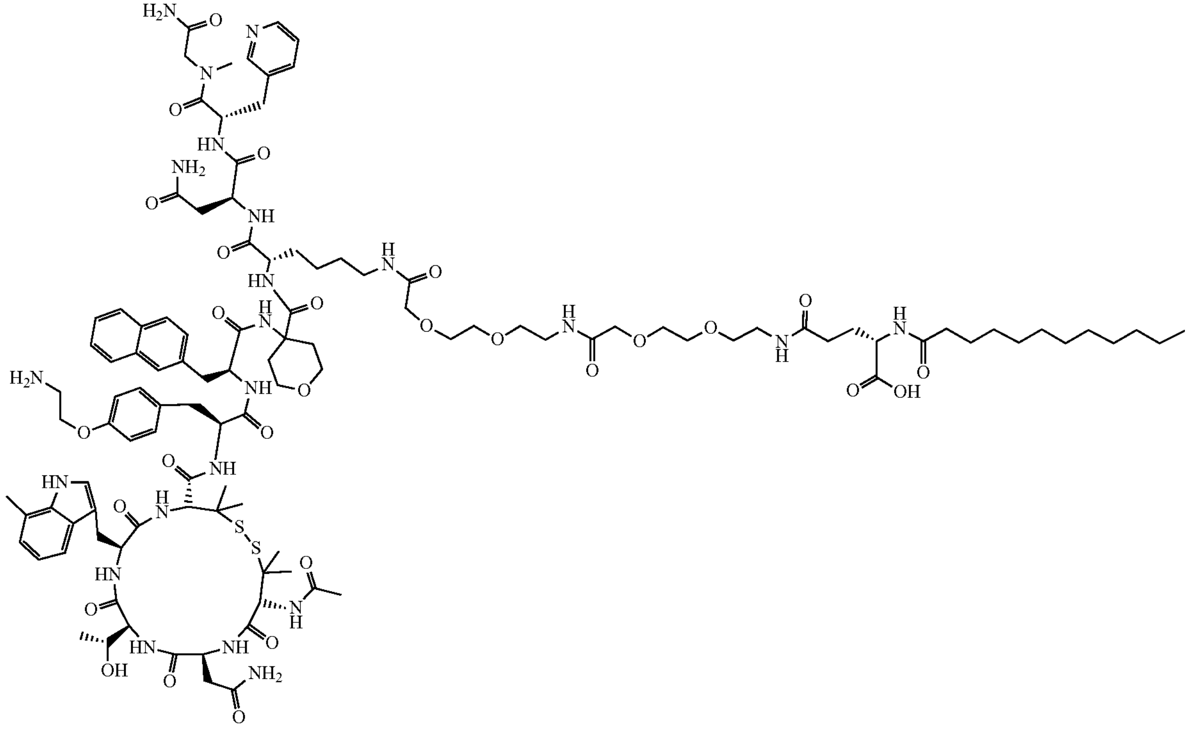<br>MeCO-Pen(3)-N-T-7MeW-K(Ac)-Pen(3)-AEF-2Nal-THP-K(PEG2PEG2gEC14)-N-3Pya-Sar-CONH2<br>CCCCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)C(O)=O)=O |

TABLE 1M-continued
| SEQ ID | Compounds. Structure Peptide Sequence Smiles |
|---|---|
| 384 | 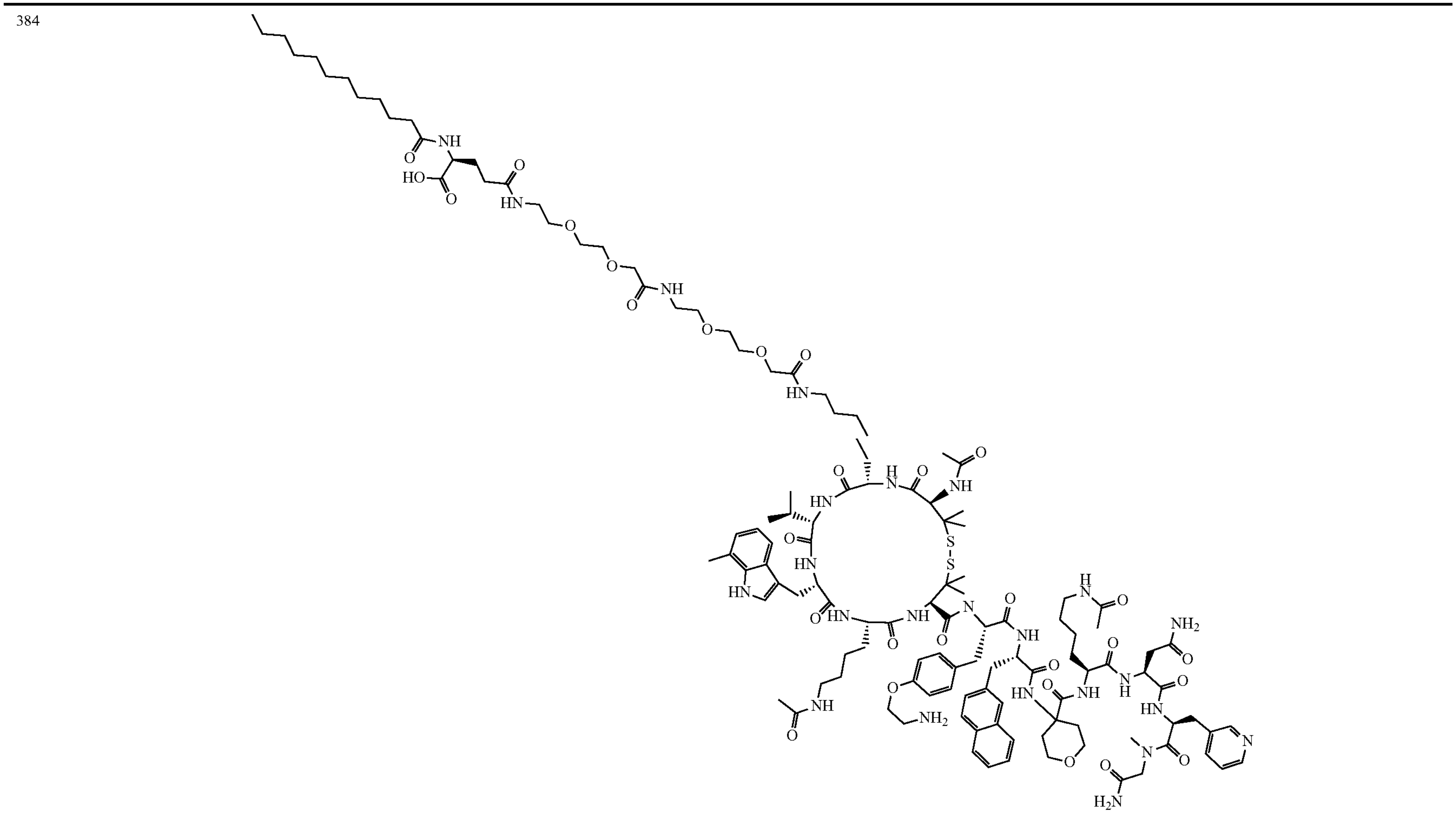 MeCO-Pen(3)-K(PEG2PEG2gEC12)-T-7MeW-K(Ac)-Pen(3)-AEF-2Nal-THP-K(Ac)-N-3Pya-Sar-CONH2 |

TABLE 1M-continued

| Compounds. | |
|---|---|
| SEQ ID | Structure<br>Peptide Sequence<br>Smiles |
| | CCCCCCCCCCCCC(N[C@@H](CCC(NCCOCCOCC(NCCOCCOCC(NCCCC[C@@H](C(N[C@@H][C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(O)=O)=O |
| 385 | 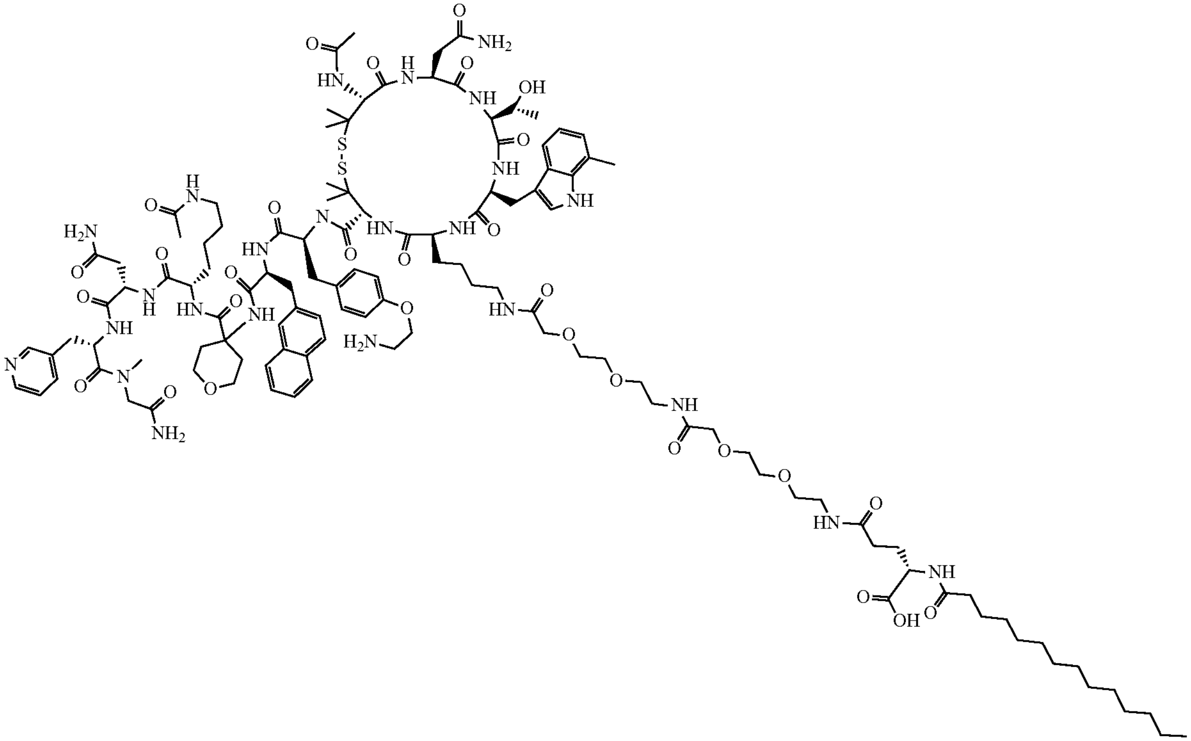 [SMILES: CCCCCCCCCCCCCC(=O)N[C@@H](CCC(=O)NCCOCCOCC(=O)NCCOCCOCC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)NC1=O)C(=O)O]<br>MeCO-Pen(3)-N-T-7MeW-K(PEG2PEG2gEC14)-Pen(3)-AEF-2Nal-THP-K(Ac)-N-3Pya-Sar-CONH2<br>CCCCCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N |

TABLE 1M-continued
| Compounds. | |
|---|---|
| SEQ ID | Structure<br>Peptide Sequence<br>Smiles |
| 386 | [C@@H]([C@@H](C)O)C(N[C@H]1Cc2c[nH]c3c2cccc3C)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCCCNC(C)=O)C(N[C@@H](CC(N)=O)C(N[C@@H](Cc2cnccc2)C(N(C)CC(N)=O)=O)=O)=O)=O)=O)=O)=O)=O)=O)NC1=O)=O)=O)=O)C(O)=O)=O<br>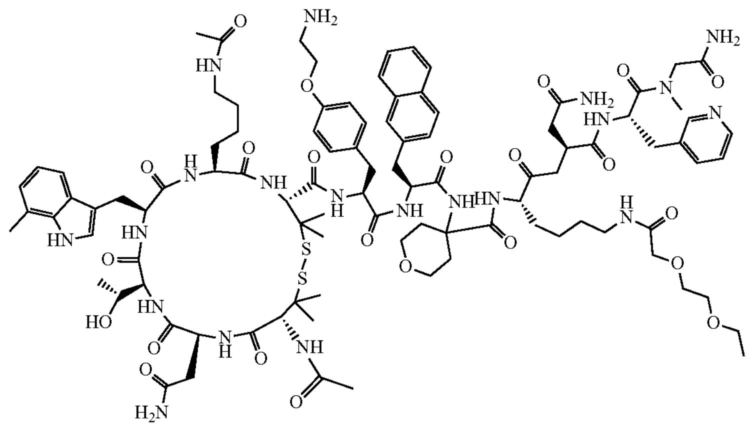 |

TABLE 1M-continued

| SEQ ID | Compounds. Structure Peptide Sequence Smiles |
|---|---|
| | 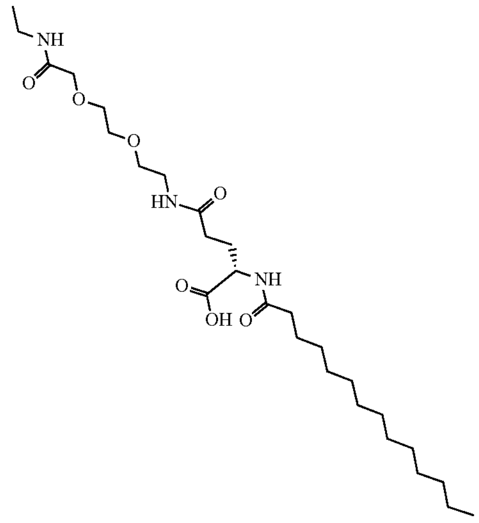 MeCO-Pen(3)-N-T-7MeW-K(Ac)-Pen(3)-AEF-2Nal-THP-K(PEG2PEG2gEC12)-N-3Pya-Sar-CONH2 CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 387 | 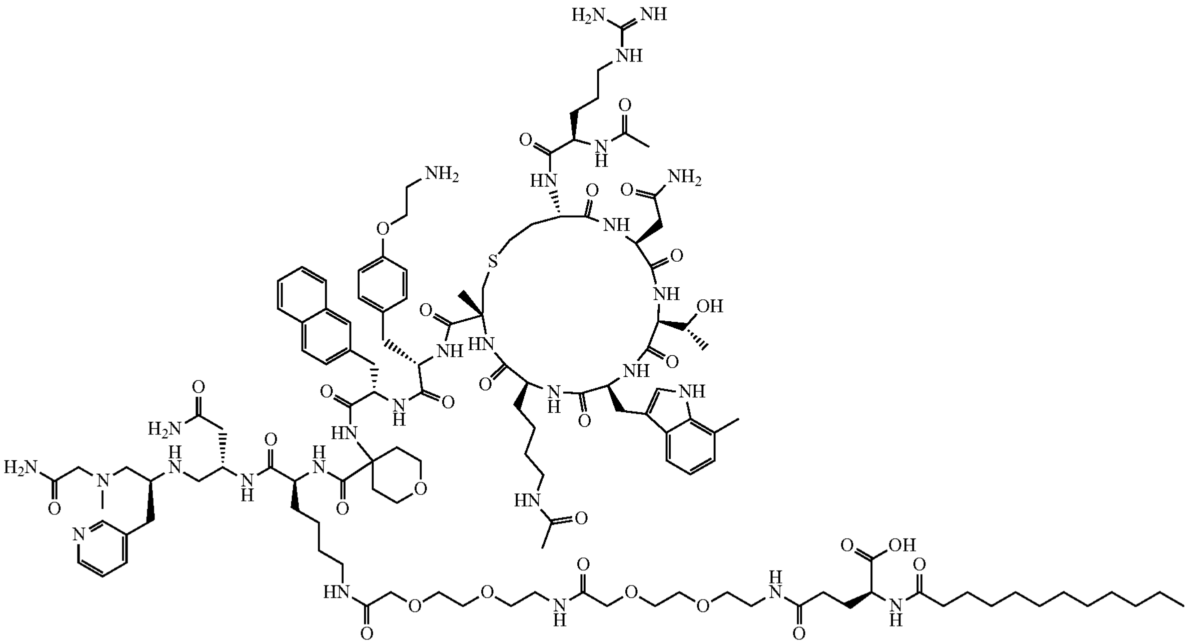 [SMILES: CCCCCCCCCCCC(=O)N[C@@H](CCC(=O)NCCOCCOCC(=O)NCCOCCOCC(=O)NCCCC[C@H](NC(=O)C1(NC(=O)[C@H](Cc2ccc3ccccc3c2)NC(=O)[C@H](Cc2ccc(OCCN)cc2)NC(=O)[C@]2(C)CSCC[C@H](NC(=O)[C@@H](CCCNC(=N)N)NC(C)=O)C(=O)N[C@@H](CC(N)=O)C(=O)N[C@@H]([C@@H](C)O)C(=O)N[C@@H](Cc3c[nH]c4c(C)cccc34)C(=O)N[C@@H](CCCCNC(C)=O)C(=O)N2)CCOCC1)C(=O)N[C@H](CN[C@@H](Cc1cccnc1)CN(C)CC(N)=O)CC(N)=O)C(=O)O]<br>MeCO-r-Abu(1)-N-T-7MeW-K(Ac)-aMeC(1)-AEF-2Nal-THP-K(PEG2PEG2gEC12)-N-3Pya-Sar-CONH2<br>CCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@](C)(CSCC[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC([C@@H](CCCNC(N)=N)NC(C)=O)=O)NC1=O)=O)=O)=O)=O)=O)=O)=O)C(O)=O)=O |

TABLE 1M-continued

Compounds.

| SEQ ID | Structure<br>Peptide Sequence<br>Smiles |
|---|---|
| 388 | 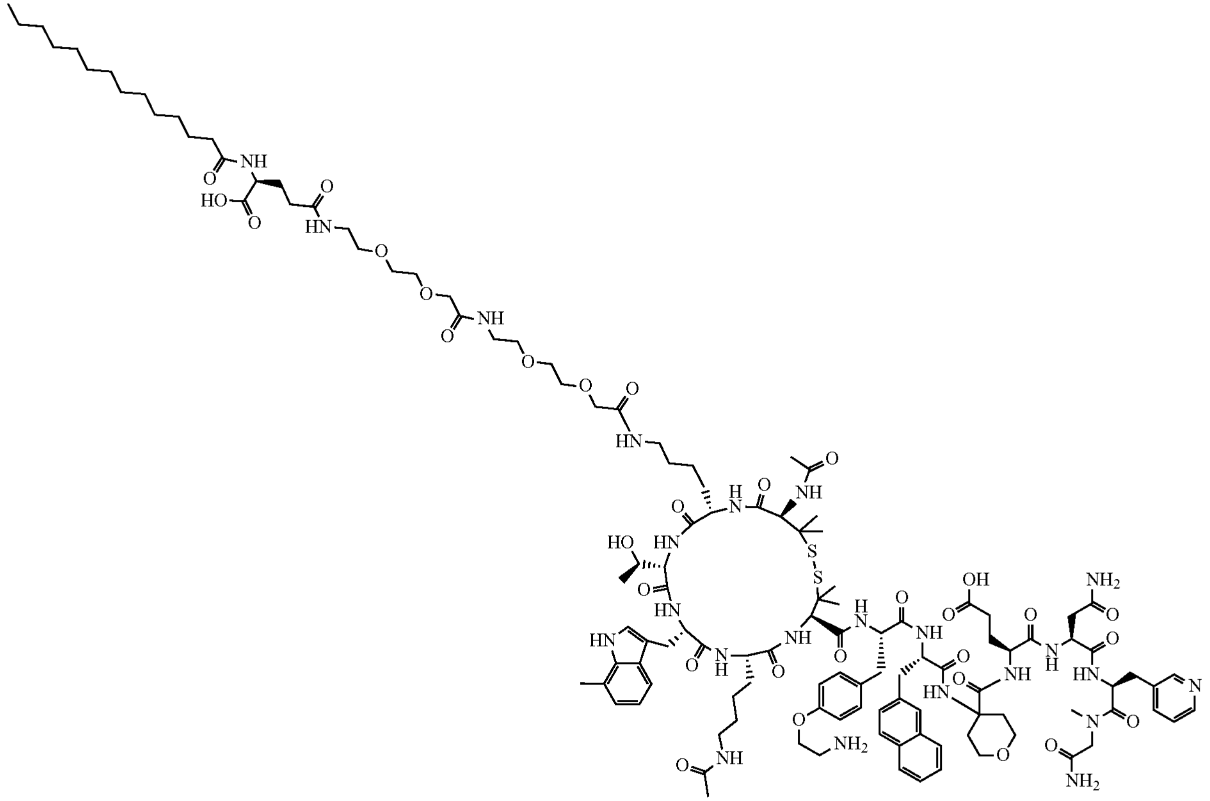 [SMILES: CCCCCCCCCCCCCC(=O)N[C@@H](CCC(=O)NCCOCCOCC(=O)NCCOCCOCC(=O)NCCCC[C@@H]1NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC(=O)[C@H](CCCCNC(C)=O)NC(=O)[C@H](Cc2c[nH]c3c(C)cccc23)NC(=O)[C@H]([C@@H](C)O)NC1=O)C(=O)O]<br>MeCO-Pen(3)-K(PEG2PEG2gEC14)-T-7MeW-K(Ac)-Pen(3)-AEF-2Nal-THP-E-N-3Pya-Sar-CONH2<br>CCCCCCCCCCCCCC(N[C@@H](CCC(NCCOCCOCC(NCCOCCOCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]INC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)=O)=O)=O)C(O)=O)=O |

TABLE 1M-continued
| Compounds. | |
|---|---|
| SEQ ID | Structure<br>Peptide Sequence<br>Smiles |
| 389 | 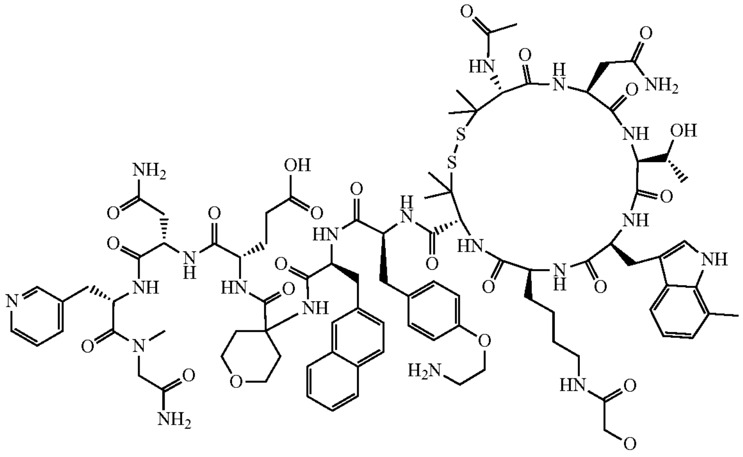 |

TABLE 1M-continued

| Compounds. | |
| --- | --- |
| SEQ ID | Structure<br>Peptide Sequence<br>Smiles |
| | 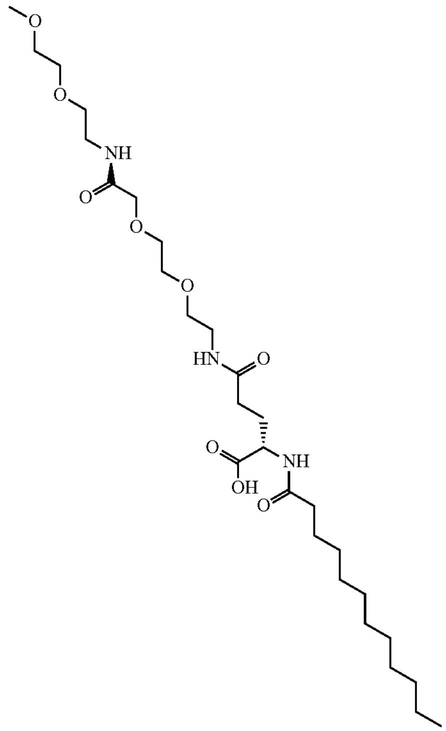<br>MeCO-Pen(3)-N-T-7MeW-K(PEG2PEG2gEC12)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued
| Compounds. | |
|---|---|
| SEQ ID | Structure<br>Peptide Sequence<br>Smiles |
| 390 | 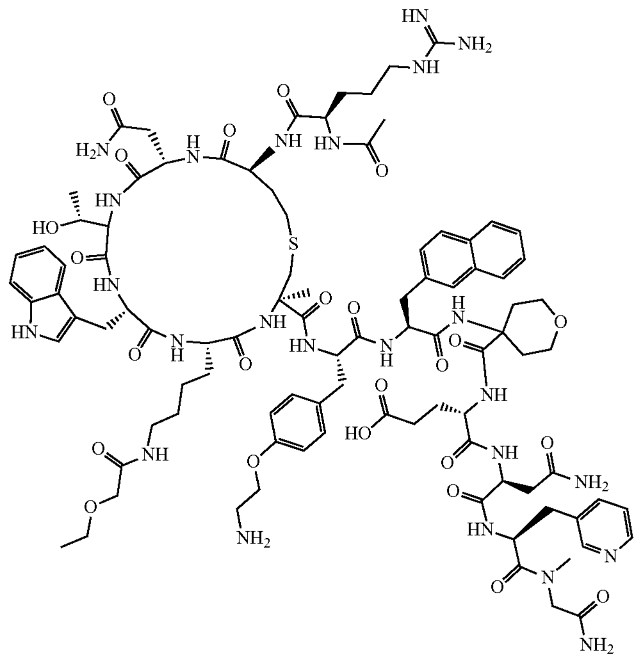 |

TABLE 1M-continued

| Compounds. | |
|---|---|
| SEQ ID | Structure<br>Peptide Sequence<br>Smiles |
| | 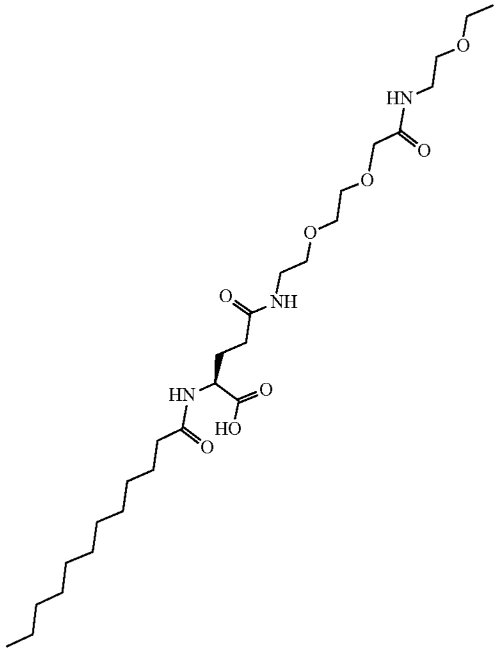<br>MeCO-r-Abu(1)-N-T-W-K(PEG2PEG2gEC12)-aMeC(1)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@](C)(CSCC[C@@H](C(N[C@@H](CC(N)=O)C(NC([C@H](C)O)C(N[C@H]1Cc2c[nH]c3c2cccc3)=O)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)=O)=O)C(O)=O)=O |

TABLE 1M-continued
| Compounds. | |
|---|---|
| SEQ ID | Structure<br>Peptide Sequence<br>Smiles |
| 391 | 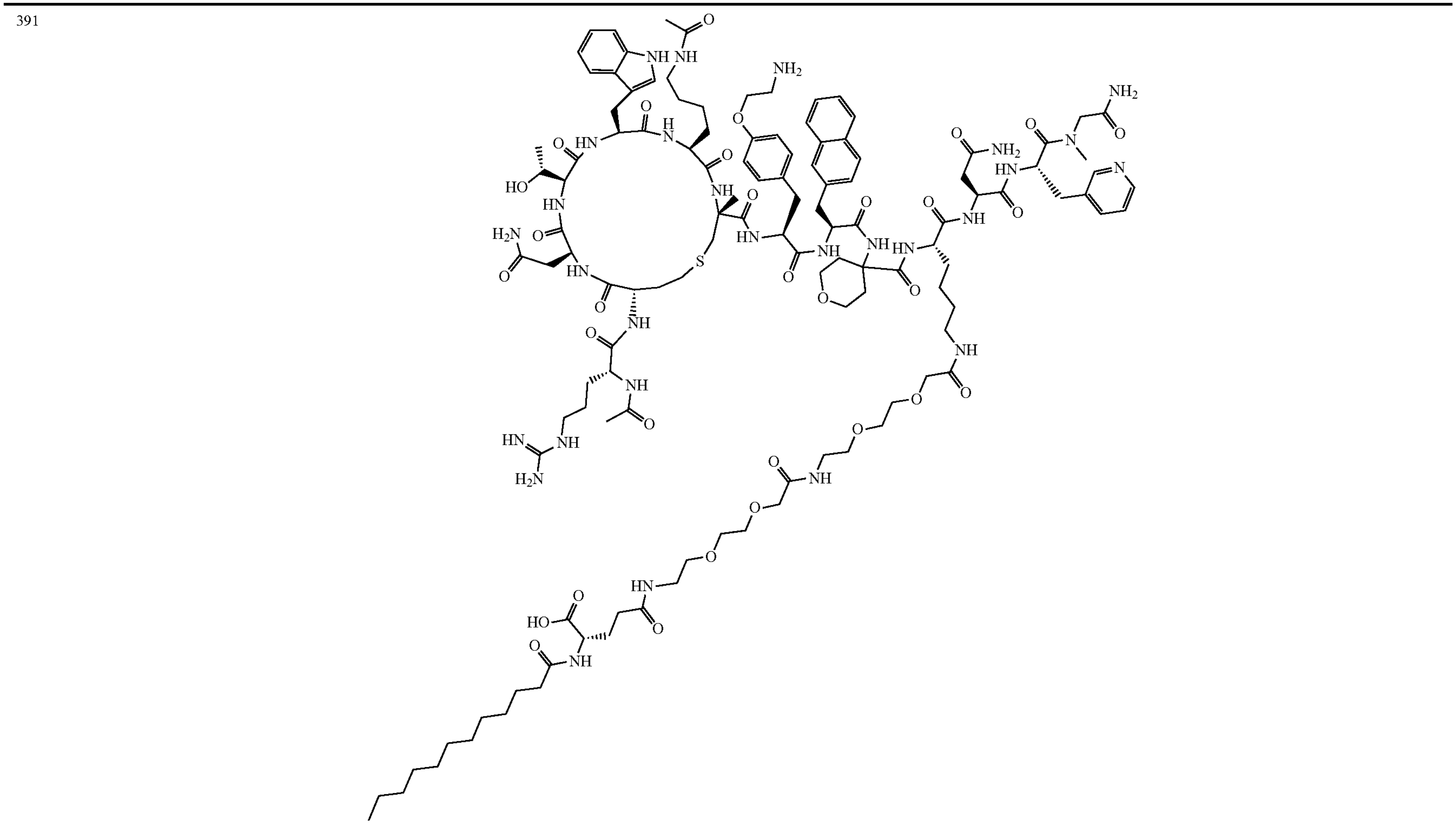 |

TABLE 1M-continued

| SEQ ID | Compounds.<br>Structure<br>Peptide Sequence<br>Smiles |
|---|---|
| 392 | MeCO-r-Abu(1)-N-T-W-K(Ac)-aMeC(1)-AEF-2Nal-THP-K(PEG2PEG2gEC12)-N-3Pya-Sar-CONH2<br>CCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@](C)(CSCC[C@@H](C(N[C@@H](CC(N)=O)C(N[C@@H]([C@@H](C)O)C(N[C@@H](Cc1c[nH]c2c1cccc2)C(N[C@H]1CCCCNC(C)=O)=O)=O)=O)=O)NC([C@@H](CCCNC(N)=N)NC(C)=O)=O)NC1=O)=O)=O)=O)=O)=O)=O)=O)C(O)=O)=O<br>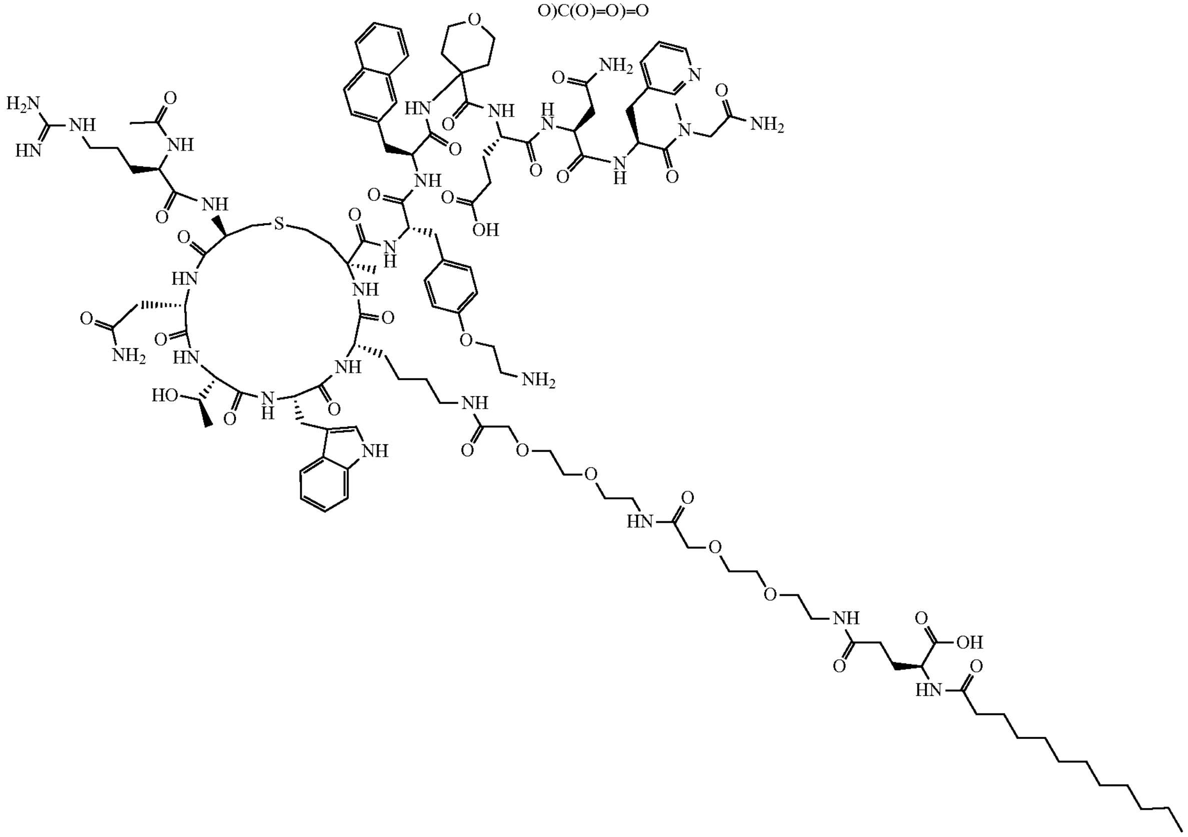 |

TABLE 1M-continued

| Compounds. | |
|---|---|
| SEQ ID | Structure<br>Peptide Sequence<br>Smiles |
| | MeCO-r-Abu(1)-N-T-W-K(Ac)-aMeC(1)-AEF-2Nal-THP-E-N-3Pya-Sar-K(PEG2PEG2gEC12)-CONH2<br>CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@](C)(CSCC[C@@H](C(N[C@@H](CC(N)=O)C(N[C@@H]([C@@H](C)O)C(N[C@@H](Cc1c[nH]c2c1cccc2)C(N[C@H]1CCCCNC(C)=O)=O)=O)=O)=O)NC([C@@H](CCCNC(N)=N)NC(C)=O)=O)NC1=O)=O)=O)=O)=O)=O)=O)=O)=O)=O)=O)=O)C(O)=O)=O |

TABLE 1M-continued

| Compounds. | |
| --- | --- |
| SEQ ID | Structure<br>Peptide Sequence<br>Smiles |
| 393 | 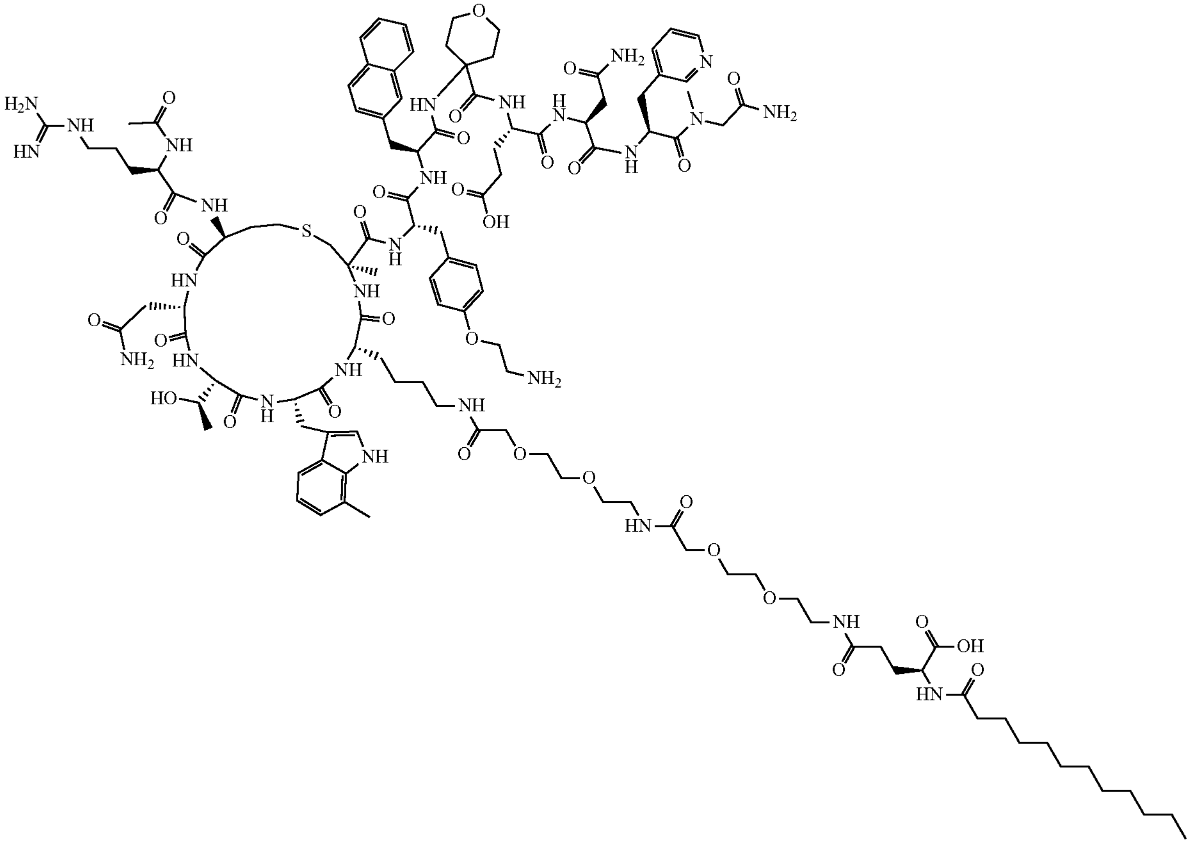 [SMILES: CCCCCCCCCCCC(=O)N[C@@H](CCC(=O)NCCOCCOCC(=O)NCCOCCOCC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(C)=O)CCSC[C@@](C)(C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O)C(=O)O]<br>MeCO-r-Abu(1)-N-T-7MeW-K(PEG2PEG2gEC12)-aMeC(1)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@](C)(CSCC[C@@H](C(N[C@@H](CC(N)=O)C(N[C@@H]([C@@H](C)O)C(N[C@H]1Cc2c[nH]c3c2cccc3C)=O)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@ |

TABLE 1M-continued

| SEQ ID | Compounds. Structure Peptide Sequence Smiles |
|---|---|
| | @H](Cc2cnccc2)C(N(C)CC(N)=O)=O)=O)=O)=O)=O)=O)=O)=O)NC1=O)=O)=O)=O)C(O)=O)=O |
| 394 | 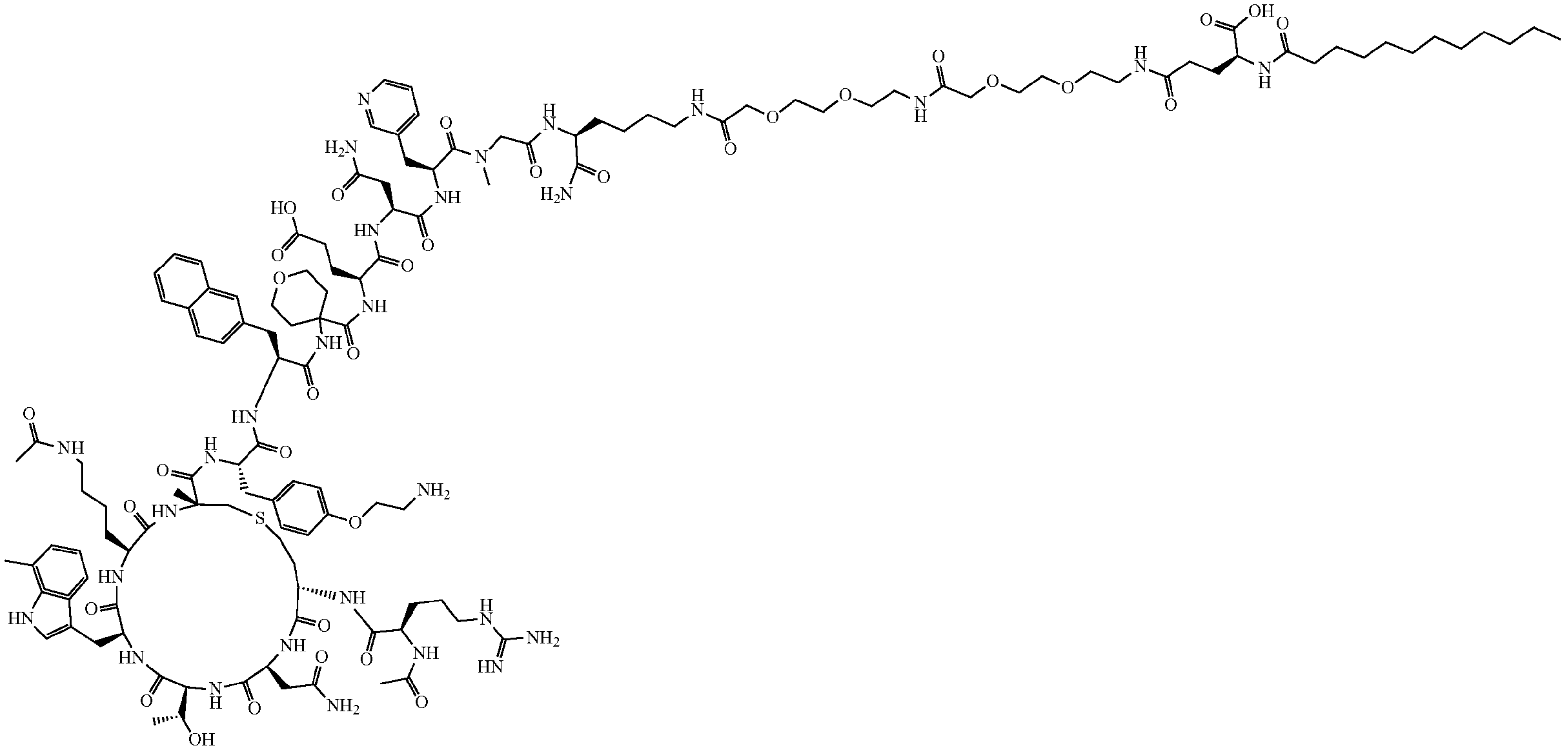 MeCO-r-Abu(1)-N-T-7MeW-K(Ac)-aMeC(1)-AEF-2Nal-THP-E-N-3Pya-Sar-K(PEG2PEG2gEC12)-CONH2 CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@](C)(CSCC[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)= |

TABLE 1M-continued

| SEQ ID | Compounds. Structure Peptide Sequence Smiles |
|---|---|
| | O)=O)=O)=O)NC([C@@H](CCCNC(N)=N)NC(C)=O)=O)NC1=O)=O)=O)=O)=O)=O)=O)=O)=O)=O)=O)=O)C(O)=O)=O |
| 395 | 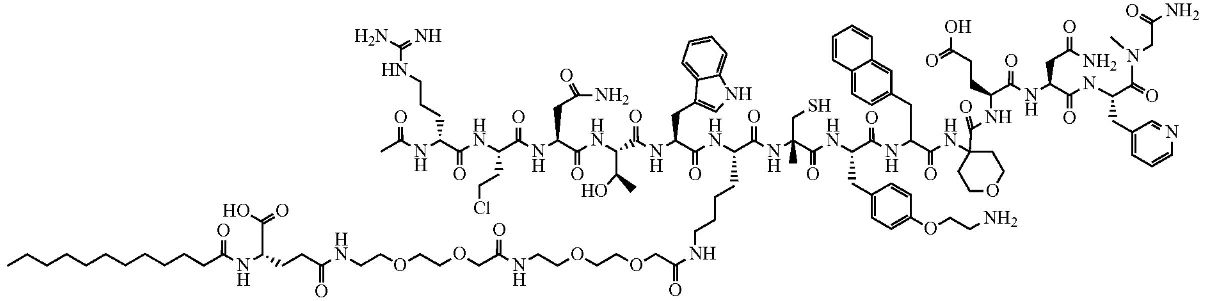 [SMILES: CCCCCCCCCCCC(=O)N[C@@H](CCC(=O)NCCOCCOCC(=O)NCCOCCOCC(=O)NCCCC[C@H](NC(=O)[C@H](Cc1c[nH]c2ccccc12)NC(=O)[C@@H](NC(=O)[C@H](CC(N)=O)NC(=O)[C@H](CCCl)NC(=O)[C@@H](CCCNC(=N)N)NC(C)=O)[C@@H](C)O)C(=O)N[C@](C)(CS)C(=O)N[C@@H](Cc1ccc(OCCN)cc1)C(=O)NC(Cc1ccc2ccccc2c1)C(=O)NC1(C(=O)N[C@@H](CCC(=O)O)C(=O)N[C@@H](CC(N)=O)C(=O)N[C@@H](Cc2cccnc2)C(=O)N(C)CC(N)=O)CCOCC1)C(=O)O] MeCO-r-Abu-N-T-W-K(PEG2PEG2gEC12)-aMeC-AEF-2Nal-THP-E-N-3Pya-Sar-CONH2 CCCCCCCCCCCC(N[C@@H](CCC(NCCOCCOCC(NCCOCCOCC(NCCCC[C@@H](C(N[C@@](C)(CS)C(N[C@@H](Cc(cc1)ccc1OCCN)C(N[C@@H](Cc1cc2ccccc2cc1)C(NC1(CCOCC1)C(N[C@@H](CCC(O)=O)C(N[C@@H](CC(N)=O)C(N[C@@H](Cc1cnccc1)C(N(C)CC(N)=O)=O)=O)=O)=O)=O)=O)=O)NC([C@H](Cc1c[nH]c2c1cccc2)NC([C@H]([C@@H](C)O)NC([C@H](CC(N)=O)NC([C@H](CCCl)NC([C@@H](CCCNC(N)=N)NC(C)=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 396 | 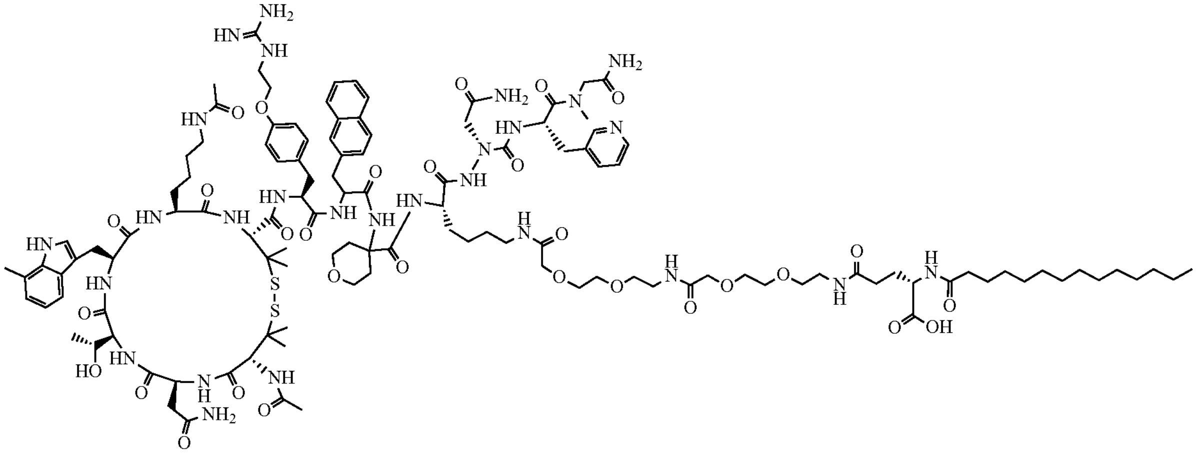<br>MeCO-Pen(3)-N-T-7MeW-K(Ac)-Pen(3)-AEF(G)-2Nal-THP-K(PEG2PEG2gEC14)-N-3Pya-Sar-CONH2<br>CCCCCCCCCCCCCC(N[C@@H](CCC(NCCOCCOCC(NCCOCCOCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCNC(N)=N)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)C(O)=O)=O |

TABLE 1M-continued

| SEQ ID | Compounds. Structure Peptide Sequence Smiles |
|---|---|
| 397 | 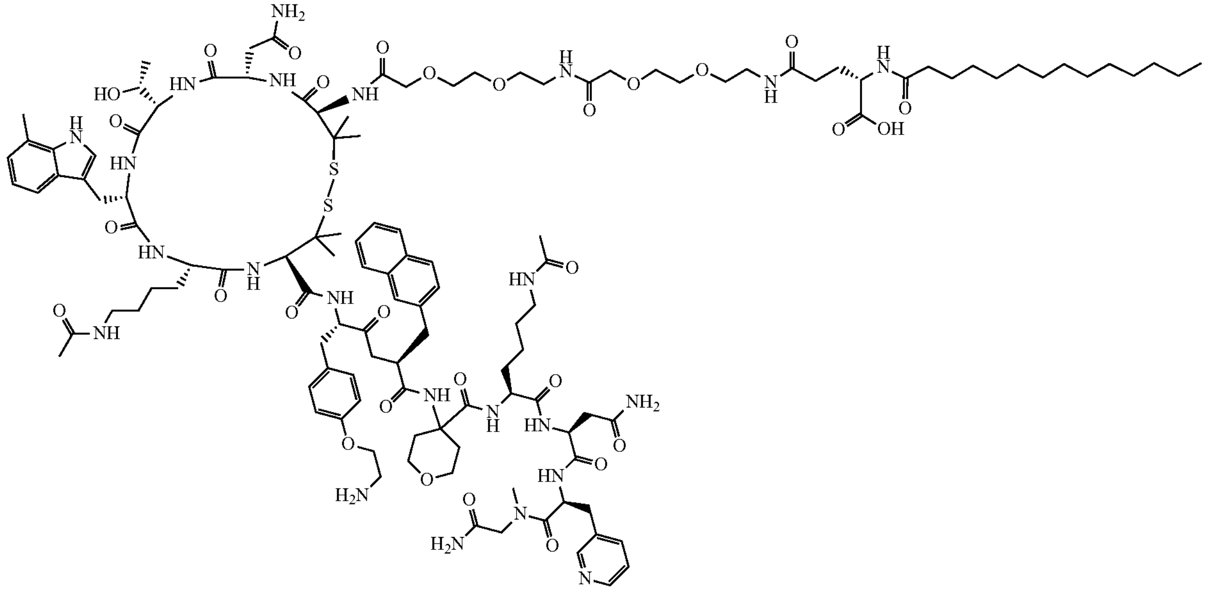 [SMILES: CCCCCCCCCCCCCC(=O)N[C@@H](CCC(=O)NCCOCCOCC(=O)NCCOCCOCC(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)C[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>C12gEPEG2PEG2CO-Pen(3)-N-T-7MeW-K(Ac)-Pen(3)-AEF-2Nal-THP-K(Ac)-N-3Pya-Sar-CONH2<br>CCCCCCCCCCCC(N[C@@H](CCC(NCCOCCOCC(NCCOCCOCC(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCCCNC(C)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)C(O)=O)=O |

TABLE 1M-continued

| Compounds. | |
|---|---|
| SEQ ID | Structure<br>Peptide Sequence<br>Smiles |
| 398 | 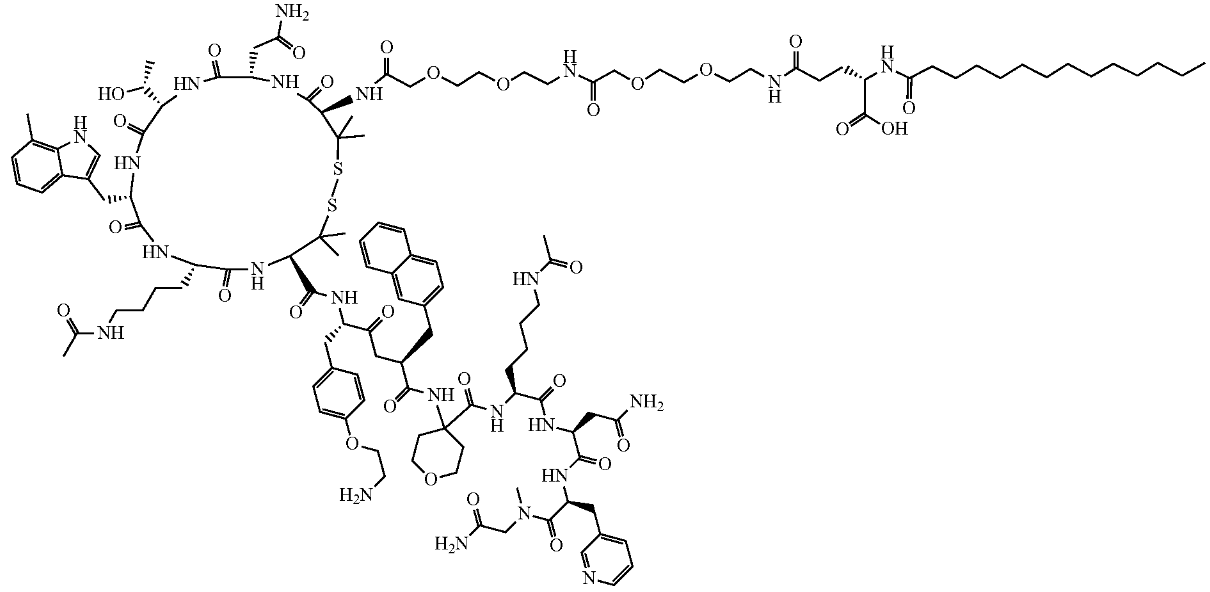 [SMILES: CCCCCCCCCCCCCC(=O)N[C@@H](CCC(=O)NCCOCCOCC(=O)NCCOCCOCC(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)C[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>C14gEPEG2PEG2CO-Pen(3)-N-T-7MeW-K(Ac)-Pen(3)-AEF-2Nal-THP-K(Ac)-N-3Pya-Sar-CONH2<br>CCCCCCCCCCCCCC(N[C@@H](CCC(NCCOCCOCC(NCCOCCOCC(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCCCNC(C)=O)C(N[C@@H](CC(N)=O)C(N[C@@H](Cc1cnccc1)C(N(C)CC(N)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)=O)=O)C(O)=O)=O |

TABLE 1M-continued

| Compounds. | |
|---|---|
| SEQ ID | Structure<br>Peptide Sequence<br>Smiles |
| 399 | 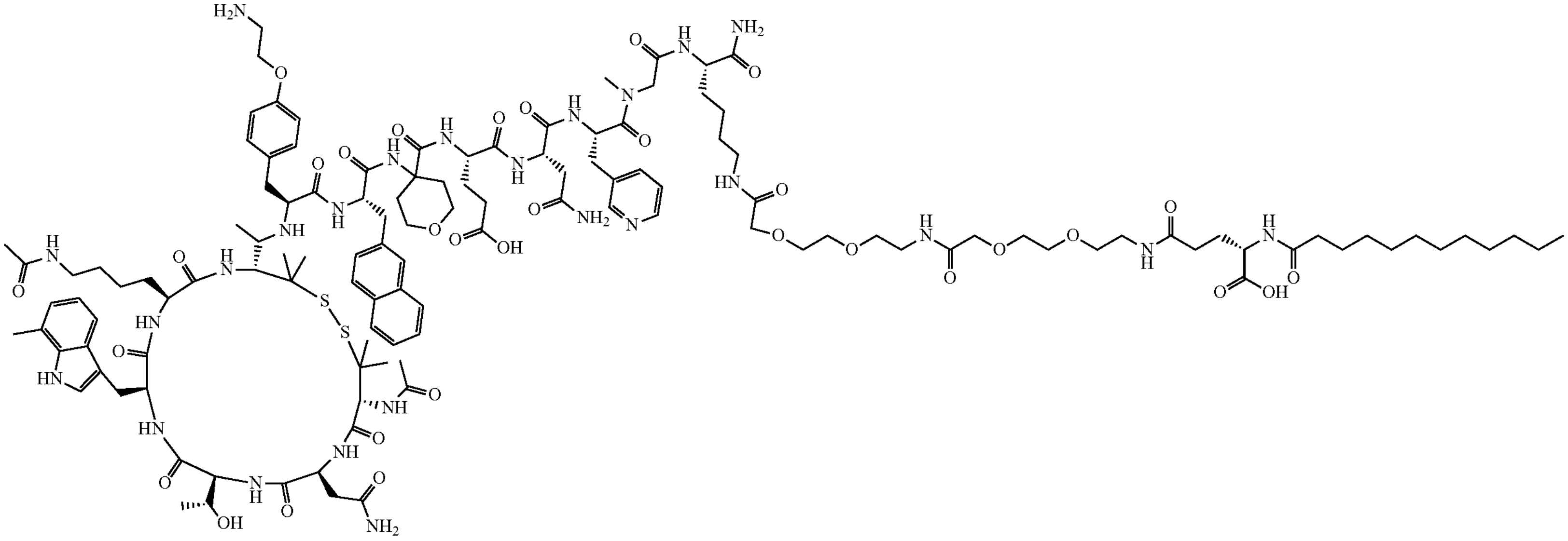 [SMILES: CCCCCCCCCCCC(=O)N[C@@H](CCC(=O)NCCOCCOCC(=O)NCCOCCOCC(=O)NCCCC[C@H](NC(=O)CN(C)C(=O)[C@H](Cc1cccnc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(C)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(N)=O)C(=O)O]<br>MeCO-Pen(3)-N-T-7MeW-K(Ac)-Pen(3)-AEF-2Nal-THP-E-N-3Pya-Sar-K(PEG2PEG2gEC12)-CONH2<br>CCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 400 | 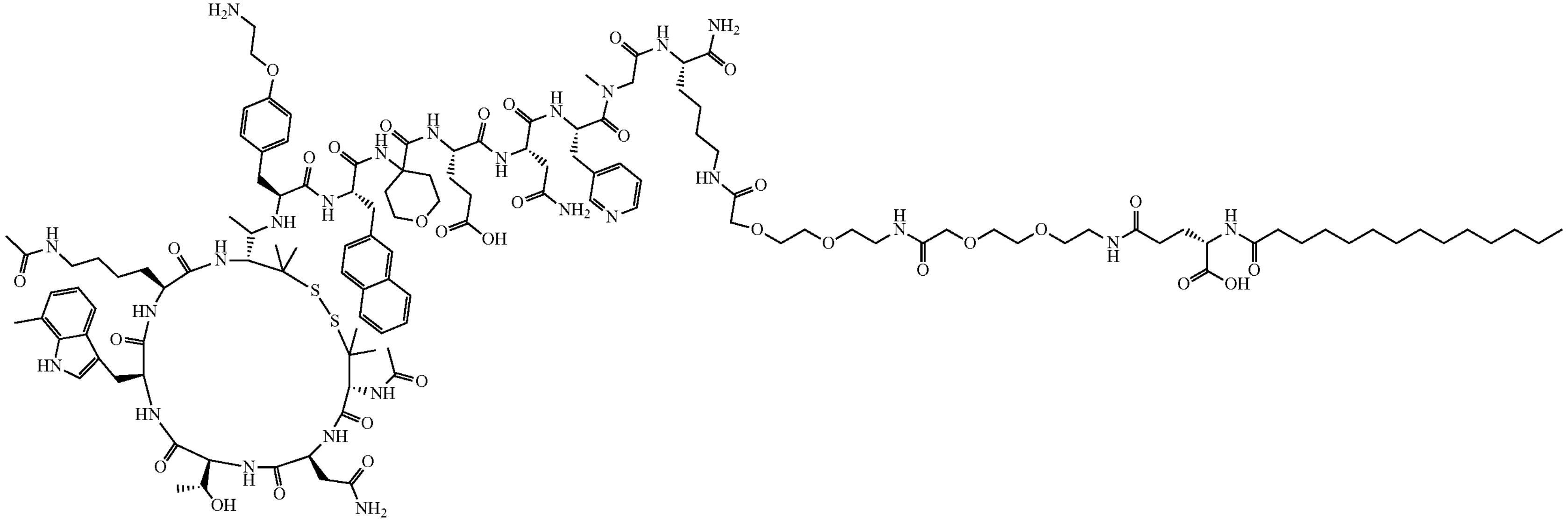 [SMILES: CCCCCCCCCCCCCC(=O)N[C@@H](CCC(=O)NCCOCCOCC(=O)NCCOCCOCC(=O)NCCCC[C@H](NC(=O)CN(C)C(=O)[C@H](Cc1cccnc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(C)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(N)=O)C(=O)O]<br>MeCO-Pen(3)-N-T-7MeW-K(Ac)-Pen(3)-AEF-2Nal-THP-E-N-3Pya-Sar-K(PEG2PEG2gEC14)-CONH2<br>CCCCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O)C(O)=O)=O |

TABLE 1M-continued

| Compounds. | |
|---|---|
| SEQ ID | Structure<br>Peptide Sequence<br>Smiles |
| 401 | 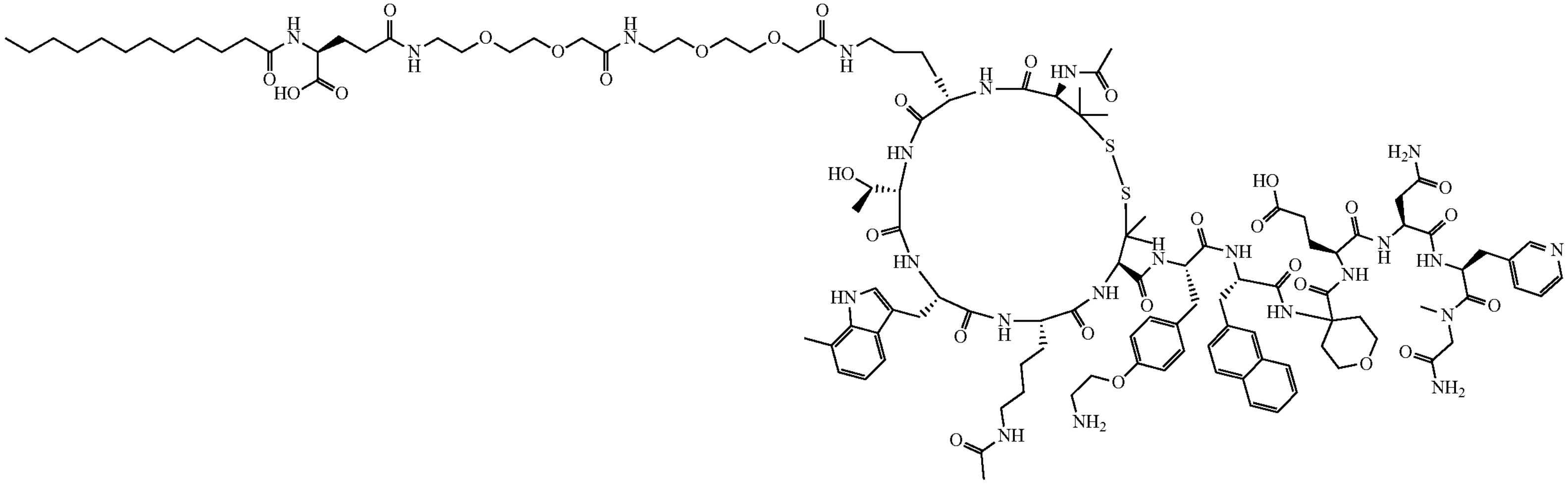 [SMILES: CCCCCCCCCCCC(=O)N[C@@H](CCC(=O)NCCOCCOCC(=O)NCCOCCOCC(=O)NCCCC[C@@H]1NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC(=O)[C@H](CCCCNC(C)=O)NC(=O)[C@H](Cc2c[nH]c3c(C)cccc23)NC(=O)[C@H]([C@@H](C)O)NC1=O)C(=O)O]<br>MeCO-Pen(3)-K(PEG2PEG2gEC12)-T-7MeW-K(Ac)-Pen(3)-AEF-2Nal-THP-E-N-3Pya-Sar-CONH2<br>CCCCCCCCCCCC(N[C@@H](CCC(NCCOCCOCC(NCCOCCOCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)=O)=O)=O)C(O)=O)=O |

TABLE 1M-continued

| Compounds. | |
|---|---|
| SEQ ID | Structure<br>Peptide Sequence<br>Smiles |
| 402 | 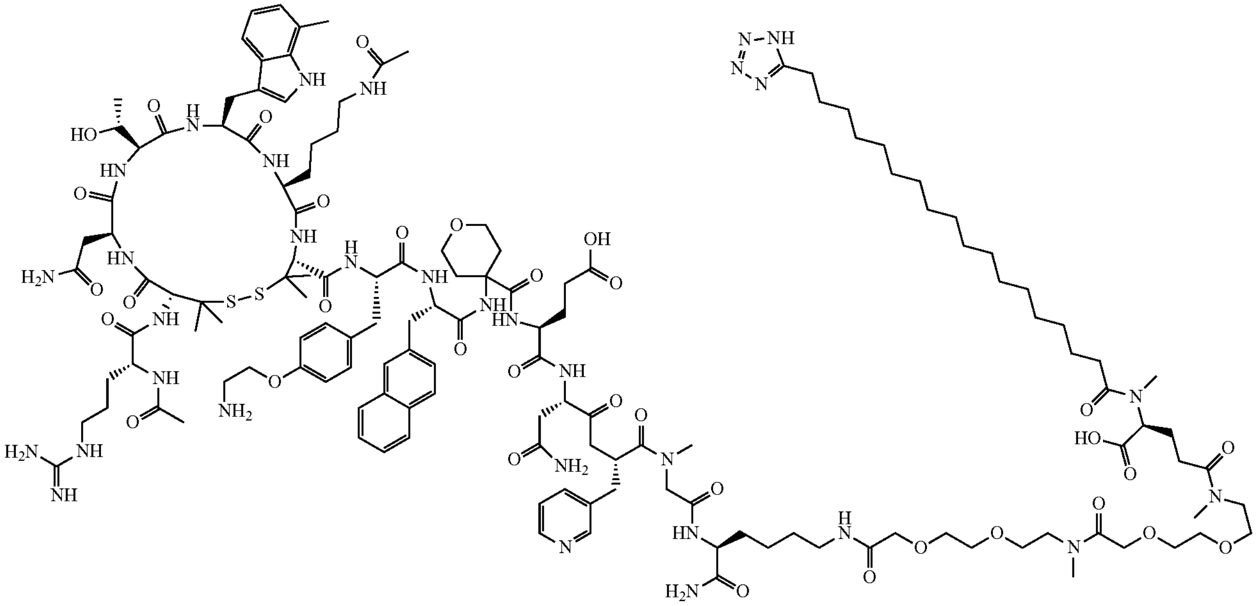 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)C[C@@H](Cc3cccnc3)C(=O)N(C)CC(=O)N[C@@H](CCCCNC(=O)COCCOCCN(C)C(=O)COCCOCCN(C)C(=O)CC[C@@H](C(=O)O)N(C)C(=O)CCCCCCCCCCCCCCCCCc3nnn[nH]3)C(N)=O)CCOCC2)NC1=O]<br>MeCO-r-Pen(3)-N-T-7MeW-K(Ac)-Pen(3)-AEF-2Nal-THP-E-N-3Pya-Sar-K(PEG2NMePEG2NMegENMeC18Tetrazole)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(N)=N)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCN(C)C(COCCOCCN(C)C(CC[C@@H](C(O)=O)N(C)C(CCCCCCCCCCCCCCCCCCc2nnn[nH]2)=O)=O)=O)=O)C(N)=O)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 403 | 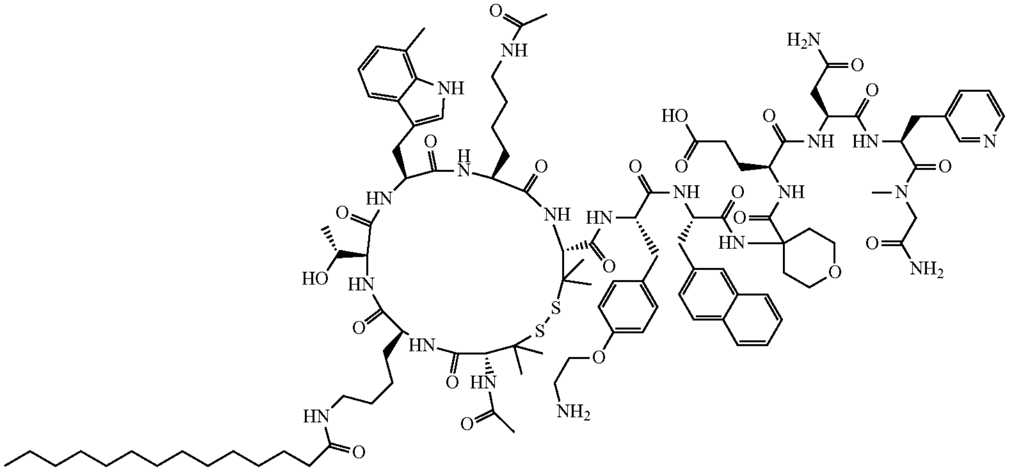 [SMILES: CCCCCCCCCCCCCC(=O)NCCCC[C@@H]1NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC(=O)[C@H](CCCCNC(C)=O)NC(=O)[C@H](Cc2c[nH]c3c(C)cccc23)NC(=O)[C@H]([C@@H](C)O)NC1=O]<br>MeCO-Pen(3)-K(C14)-T-7MeW-K(Ac)-Pen(3)-AEF-2Nal-THP-E-N-3Pya-Sar<br>CCCCCCCCCCCCCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)=O |

TABLE 1M-continued

| SEQ ID | Compounds.<br>Structure<br>Peptide Sequence<br>Smiles |
|---|---|
| 404 | 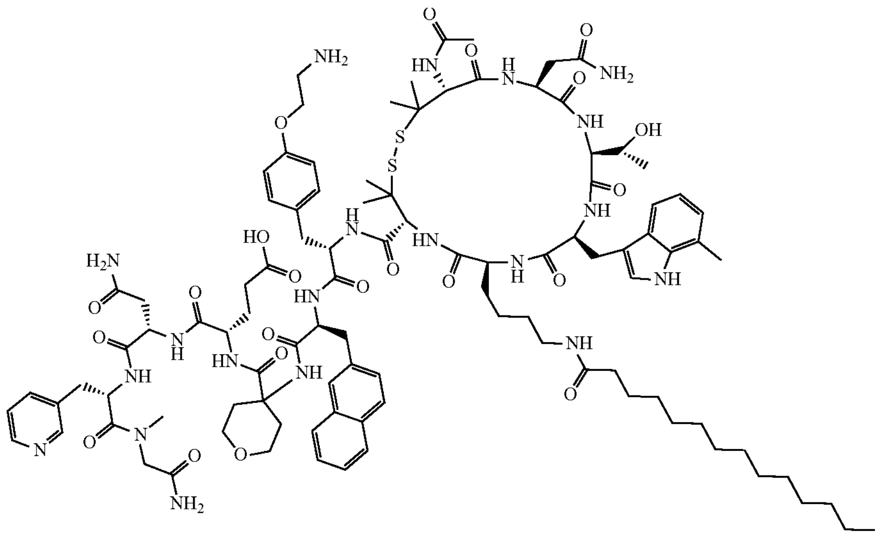 [SMILES: CCCCCCCCCCCCCC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>MeCO-Pen(3)-N-T-7MeW-K(C14)-Pen(3)-AEF-2Nal-THP-E-N-3Pya-Sar<br>CCCCCCCCCCCCCC(NCCCC[C@@H](C(N[C@@H](C(C)(C)SSC(C)(C)[C@@H](C(N[C@@H](CC(N)=O)C(N[C@@H]([C@@H](C)O)C(N[C@H]1Cc2c[nH]c3c2cccc3C)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O |

TABLE 1M-continued

| Compounds. | |
| --- | --- |
| SEQ ID | Structure<br>Peptide Sequence<br>Smiles |
| 405 | 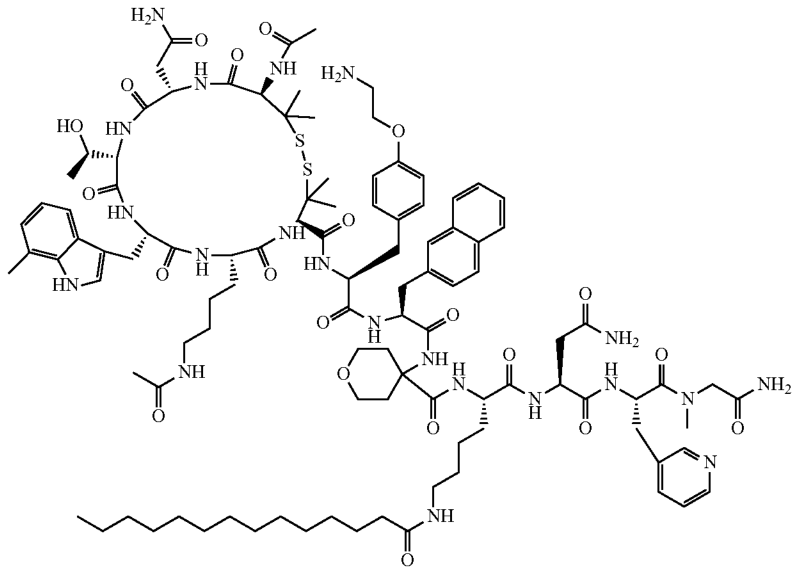 [SMILES: CCCCCCCCCCCCCC(=O)NCCCC[C@H](NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(=O)N[C@@H](CC(N)=O)C(=O)N[C@@H](Cc1cccnc1)C(=O)N(C)CC(N)=O]<br>MeCO-Pen(3)-N-T-7MeW-K(Ac)-Pen(3)-AEF-2Nal-THP-K(C14)-N-3Pya-Sar<br>CCCCCCCCCCCCCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O |

TABLE 1M-continued

| SEQ ID | Compounds. Structure Peptide Sequence Smiles |
|---|---|
| 406 | 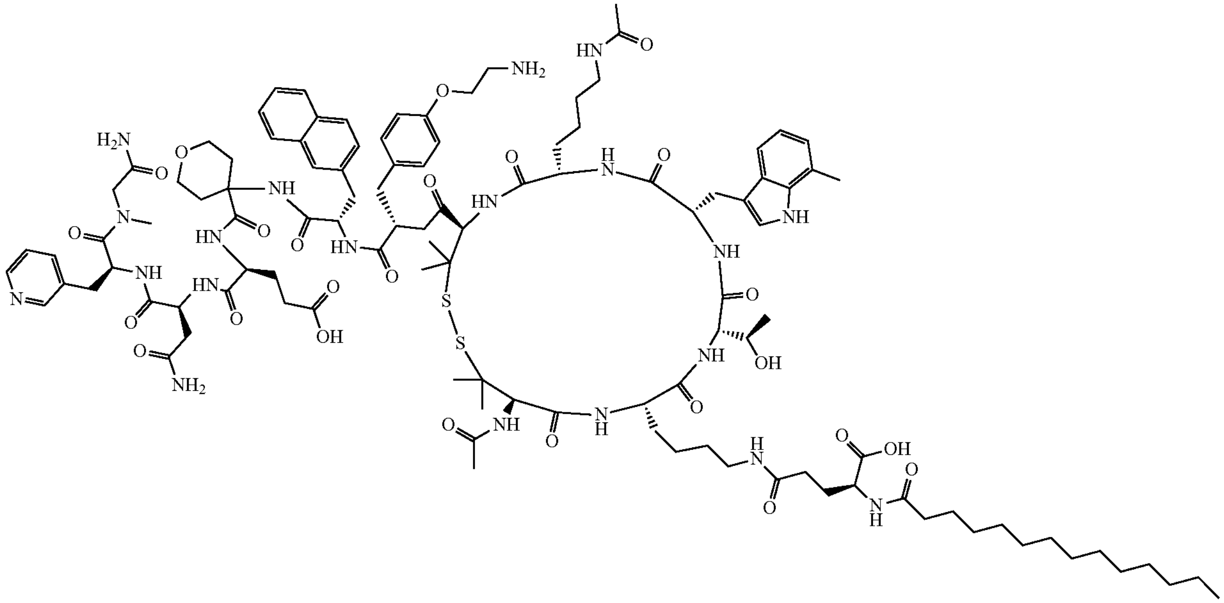 [SMILES: CCCCCCCCCCCCCC(=O)N[C@@H](CCC(=O)NCCCC[C@@H]1NC(=O)[C@@H](NC(C)=O)C(C)(C)SSC(C)(C)[C@@H](C(=O)C[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC(=O)[C@H](CCCCNC(C)=O)NC(=O)[C@H](Cc2c[nH]c3c(C)cccc23)NC(=O)[C@H]([C@@H](C)O)NC1=O)C(=O)O] MeCO-Pen(3)-K(gEC14)-T-7MeW-K(Ac)-Pen(3)-AEF-2Nal-THP-E-N-3Pya-Sar CCCCCCCCCCCCCCC(N[C@@H](CCC(NCCCC[C@@H](C(N[C@@H]([C@@H](C)O)C(N[C@@H](Cc1c[nH]c2c1cccc2C)C(N[C@@H](CCCCNC(C)=O)C(N[C@@H](C(C)(C)SSC(C)(C)[C@@H]1NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)=O)NC1=O)=O)C(O)=O)=O |

TABLE 1M-continued

| Compounds. | |
| --- | --- |
| SEQ ID | Structure<br>Peptide Sequence<br>Smiles |
| 407 | 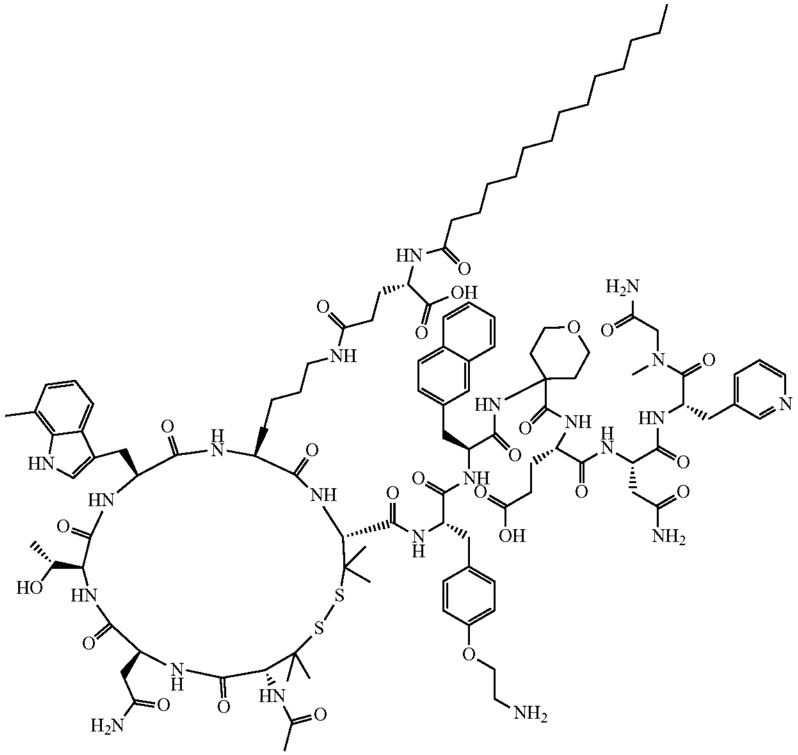 [SMILES: CCCCCCCCCCCCCC(=O)N[C@@H](CCC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O)C(=O)O]<br>MeCO-Pen(3)-N-T-7MeW-K(gEC14)-Pen(3)-AEF-2Nal-THP-E-N-3Pya-Sar<br>CCCCCCCCCCCCCC(N[C@@H](CCC(NCCCC[C@@H](C(N[C@@H](C(C)(C)SSC(C)(C)[C@@H](C(N[C@@H](CC(N)=O)C(N[C@@H]([C@@H](C)O)C(N[C@@H]1Cc2c[nH]c3c2cccc3C)=O)=O)=O)NC(C)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)NC1=O)=O)C(O)=O)=O |

TABLE 1M-continued

| Compounds. | |
|---|---|
| SEQ ID | Structure<br>Peptide Sequence<br>Smiles |
| 408 | 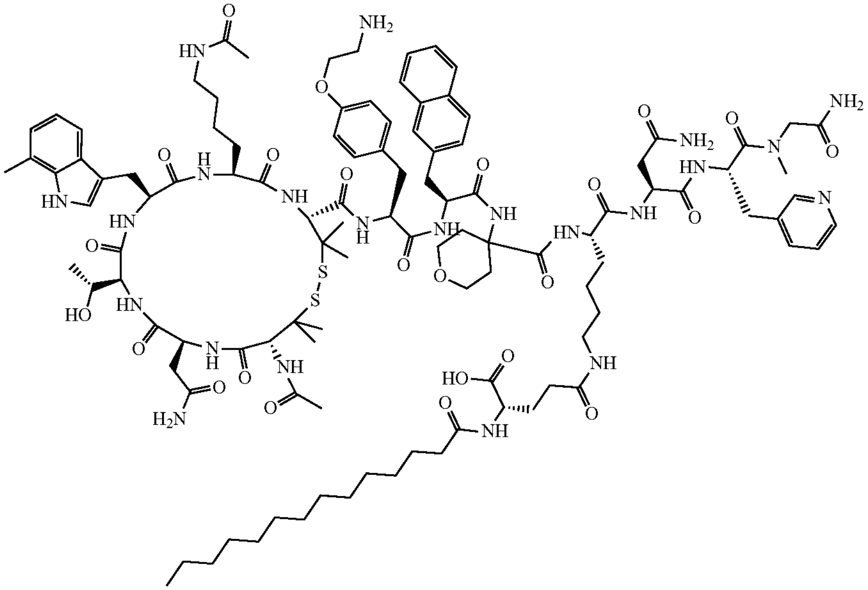 [SMILES: CCCCCCCCCCCCCC(=O)N[C@@H](CCC(=O)NCCCC[C@H](NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(=O)N[C@@H](CC(N)=O)C(=O)N[C@@H](Cc1cccnc1)C(=O)N(C)CC(N)=O)C(=O)O]<br>MeCO-Pen(3)-N-T-7MeW-K(Ac)-Pen(3)-AEF-2Nal-THP-K(gEC14)-N-3Pya-Sar<br>CCCCCCCCCCCCCC(N[C@@H](CCC(NCCCC[C@@H](C(N[C@@H](CC(N)=O)C(N[C@@H](Cc1cnccc1)C(N(C)CC(N)=O)=O)=O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)C(O)=O)=O |

TABLE 1M-continued
| Compounds. | |
|---|---|
| SEQ ID | Structure<br>Peptide Sequence<br>Smiles |
| 409 | 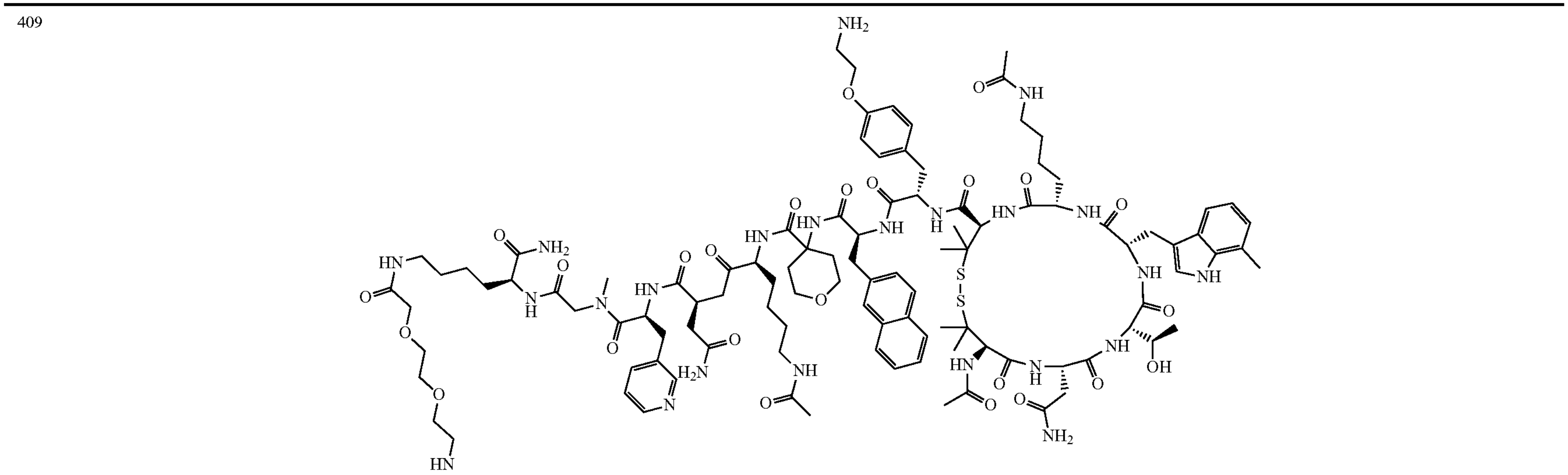 |

TABLE 1M-continued

| SEQ ID | Compounds. Structure Peptide Sequence Smiles |
|---|---|
| | 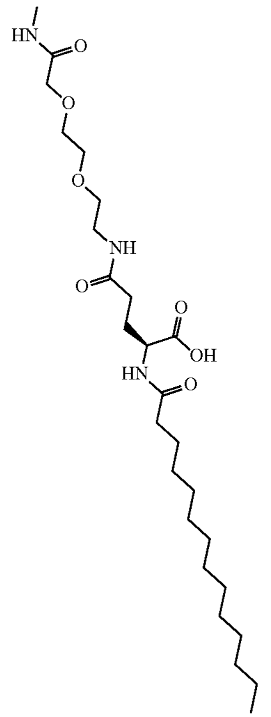 MeCO-Pen(3)-N-T-7MeW-K(Ac)-Pen(3)-AEF-2Nal-THP-K(Ac)-N-3Pya-Sar-K(PEG2PEG2gEC14)-CONH2 CCCCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCCCNC(C)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O)C(O)=O)=O |

TABLE 1M-continued

| SEQ ID | Compounds.<br>Structure<br>Peptide Sequence<br>Smiles |
|---|---|
| 410 | 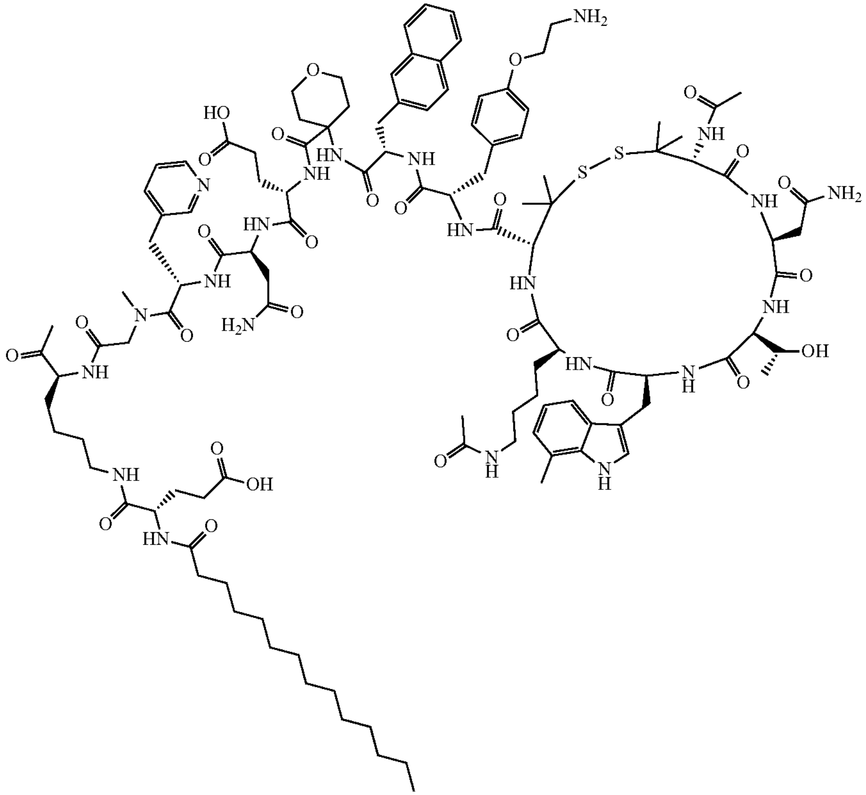 [SMILES: CCCCCCCCCCCCCC(=O)N[C@@H](CCC(=O)O)C(=O)NCCCC[C@H](NC(=O)CN(C)C(=O)[C@H](Cc1cccnc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(C)=O]<br>MeCO-Pen(3)-N-T-7MeW-K(Ac)-Pen(3)-AEF-2Nal-THP-E-N-3Pya-Sar-K(gEC14)-CONH2<br>CCCCCCCCCCCCCC(N[C@@H](CCC(O)=O)C(NCCCC[C@@H](C(C)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O |

TABLE 1M-continued

| SEQ ID | Compounds. Structure Peptide Sequence Smiles |
|---|---|
| 411 | 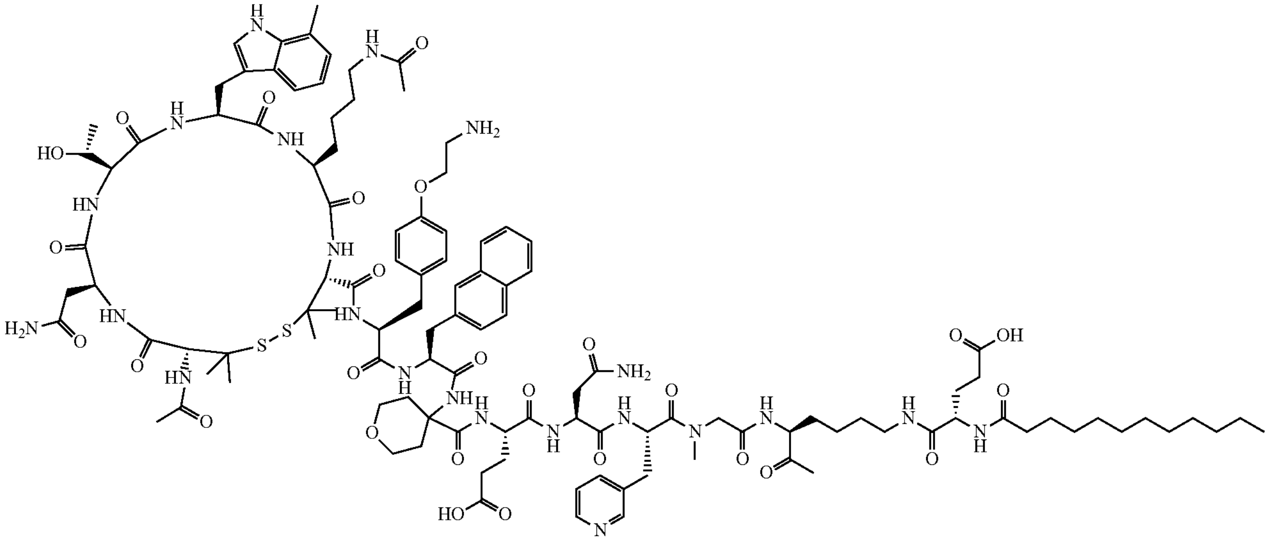 [SMILES: CCCCCCCCCCCC(=O)N[C@@H](CCC(=O)O)C(=O)NCCCC[C@H](NC(=O)CN(C)C(=O)[C@H](Cc1cccnc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(C)=O] MeCO-Pen(3)-N-T-7MeW-K(Ac)-Pen(3)-AEF-2Nal-THP-E-N-3Pya-Sar-K(C14)-CONH2 CCCCCCCCCCCCC(NCCCC[C@@H](C(C)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O |

TABLE 1M-continued

| Compounds. | |
|---|---|
| SEQ ID | Structure<br>Peptide Sequence<br>Smiles |
| 412 | 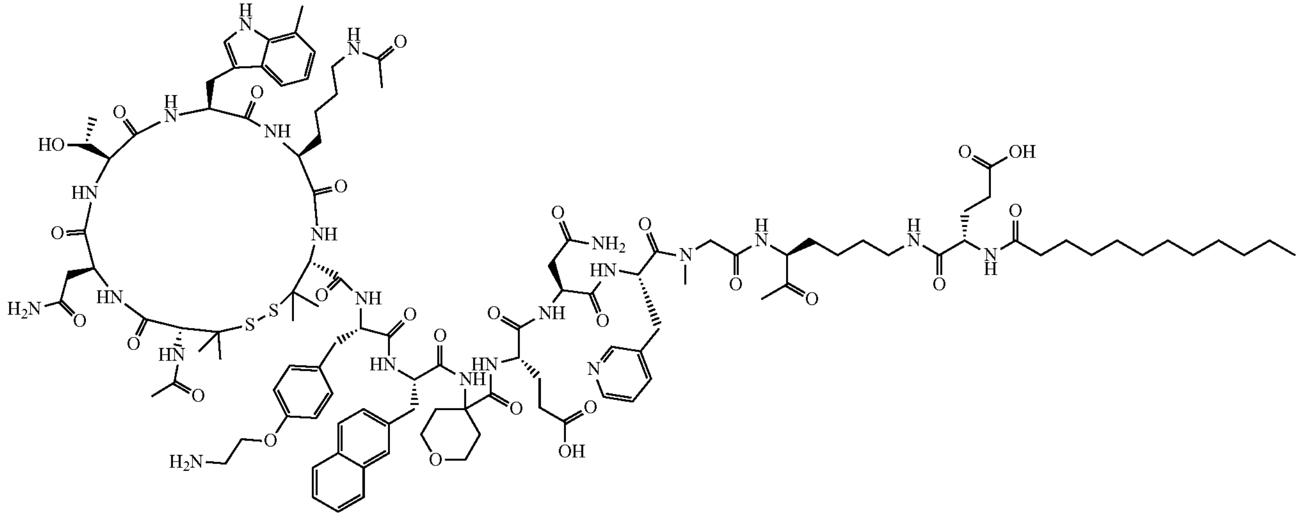 [SMILES: CCCCCCCCCCCC(=O)N[C@@H](CCC(=O)O)C(=O)NCCCC[C@H](NC(=O)CN(C)C(=O)[C@H](Cc1cccnc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(C)=O]<br>MeCO-Pen(3)-N-T-7MeW-K(Ac)-Pen(3)-AEF-2Nal-THP-E-N-3Pya-Sar-K(gEC12)-CONH2<br>CCCCCCCCCCCC(N[C@@H](CCC(O)=O)C(NCCCC[C@@H](C(C)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O |

TABLE 1M-continued

| Compounds. | |
|---|---|
| SEQ ID | Structure<br>Peptide Sequence<br>Smiles |
| 413 | 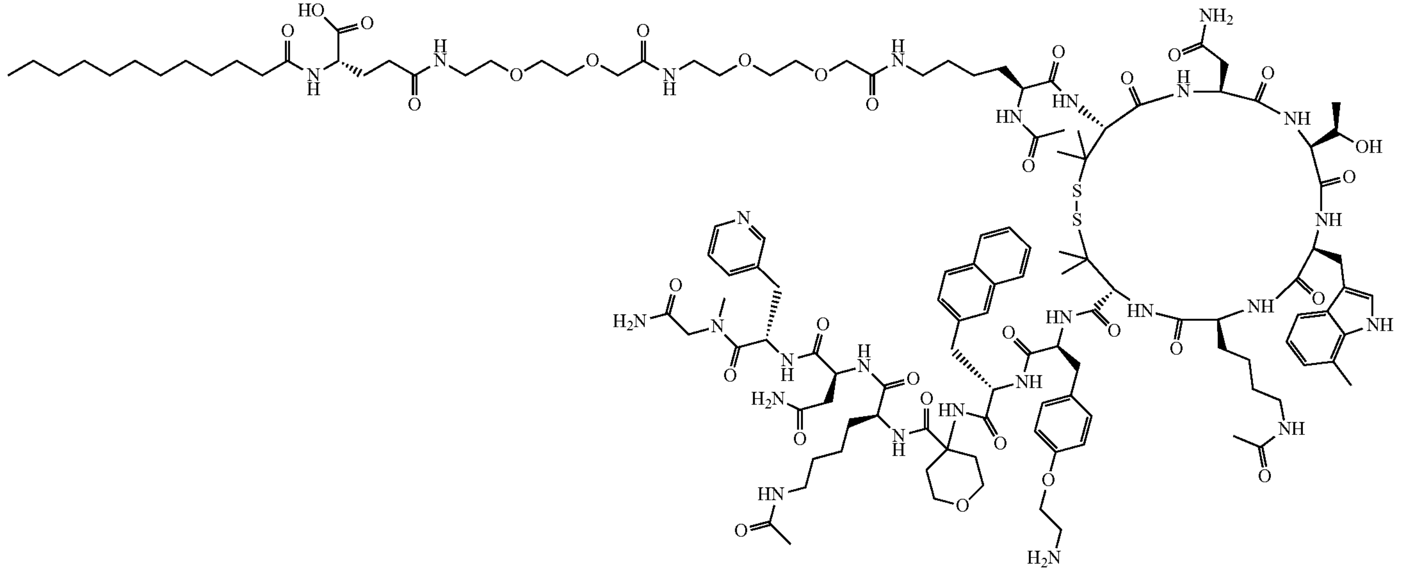 [SMILES: CCCCCCCCCCCC(=O)N[C@@H](CCC(=O)NCCOCCOCC(=O)NCCOCCOCC(=O)NCCCC[C@H](NC(C)=O)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>MeCO-k(PEG2PEG2gEC12)-Pen(3)-N-T-7MeW-K(Ac)-Pen(3)-AEF-2Nal-THP-K(Ac)-N-3Pya-Sar-CONH2<br>CCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@H](Cc1cc2ccccc2cc1)C(NC1(CCOCC1)C(N[C@@H](CCCCNC(C)=O)C(N[C@@H](CC(N)=O)C(N[C@@H](Cc1cnccc1)C(N(C)CC(N)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(C)=O)=O)=O)=O)C(O)=O)=O |

TABLE 1M-continued

| Compounds. | |
|---|---|
| SEQ ID | Structure<br>Peptide Sequence<br>Smiles |
| 414 | 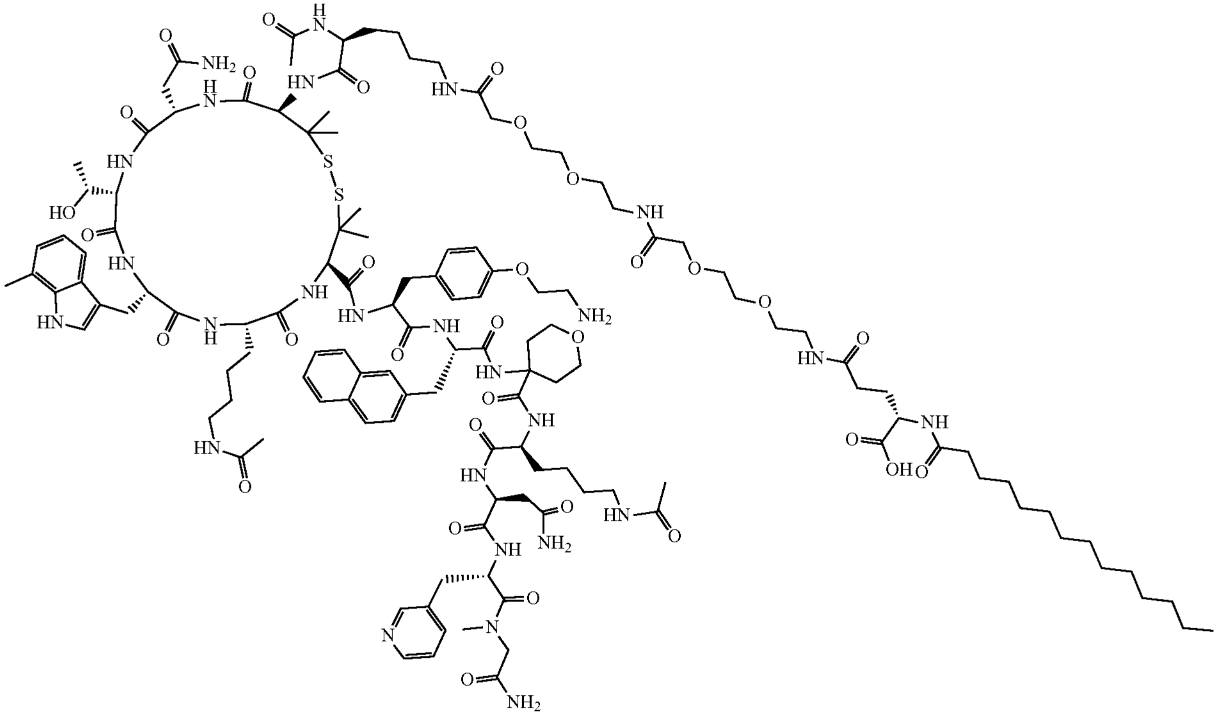 [SMILES: CCCCCCCCCCCCCC(=O)N[C@@H](CCC(=O)NCCOCCOCC(=O)NCCOCCOCC(=O)NCCCC[C@H](NC(C)=O)C(=O)N[C@@H]1C(=O)N[C@@H](CC(N)=O)C(=O)N[C@@H]([C@@H](C)O)C(=O)N[C@@H](Cc2c[nH]c3c(C)cccc23)C(=O)N[C@@H](CCCCNC(C)=O)C(=O)N[C@H](C(=O)N[C@@H](Cc2ccc(OCCN)cc2)C(=O)N[C@@H](Cc2ccc3ccccc3c2)C(=O)NC2(C(=O)N[C@@H](CCCCNC(C)=O)C(=O)N[C@@H](CC(N)=O)C(=O)N[C@@H](Cc3cccnc3)C(=O)N(C)CC(N)=O)CCOCC2)C(C)(C)SSC1(C)C)C(=O)O]<br>MeCO-k(PEG2PEG2gEC14)-Pen(3)-N-T-7MeW-K(Ac)-Pen(3)-AEF-2Nal-THP-K(Ac)-N-3Pya-Sar-CONH2<br>CCCCCCCCCCCCCC(N[C@@H](CCC(NCCOCCOCC(NCCOCCOCC(NCCCC[C@H](C(N[C@@H](C(C)(C)SSC(C)(C)[C@@H](C(N[C@@H](Cc(cc1)ccc1OCCN)C(N[C@@H](Cc1cc2ccccc2cc1)C(NC1(CCOCC1)C(N[C@@H](CCCCNC(C)=O)C(N[C@@H](CC(N)=O)C(N[C@@H](Cc1cnccc1)C(N(C)CC(N)=O)=O)=O)=O)=O)=O)=O)=O)=O)NC([C@H](CCCCNC(C)=O)NC([C@H](Cc1c[nH]c2c1cccc2C)NC([C@H]([C@@H](C)O)NC([C@H](CC(N)=O)N1)=O)=O)=O)=O)C1=O)=O)NC(C)=O)=O)=O)=O)C(O)=O)=O |

TABLE 1M-continued

| Compounds. | |
|---|---|
| SEQ ID | Structure<br>Peptide Sequence<br>Smiles |
| 415 | 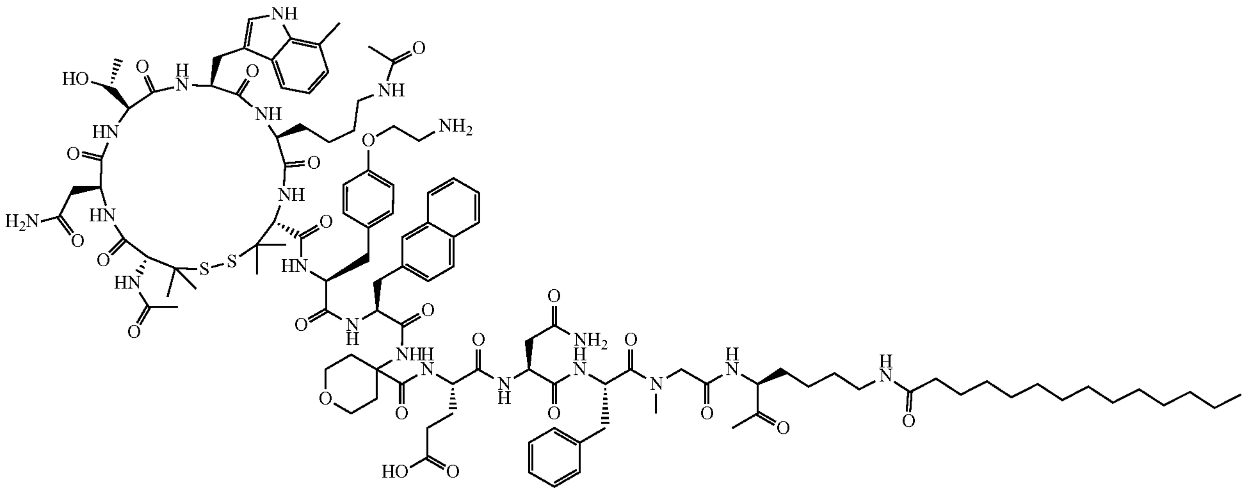 [SMILES: CCCCCCCCCCCCCC(=O)NCCCC[C@H](NC(=O)CN(C)C(=O)[C@H](Cc1ccccc1)NC(=O)[C@H](CC(N)=O)NC(=O)[C@H](CCC(=O)O)NC(=O)C1(NC(=O)[C@H](Cc2ccc3ccccc3c2)NC(=O)[C@H](Cc2ccc(OCCN)cc2)NC(=O)[C@H]2NC(=O)[C@H](CCCCNC(C)=O)NC(=O)[C@H](Cc3c[nH]c4c(C)cccc34)NC(=O)[C@H]([C@@H](C)O)NC(=O)[C@H](CC(N)=O)NC(=O)[C@@H](NC(C)=O)C(C)(C)SSC2(C)C)CCOCC1)C(C)=O]<br>MeCO-Pen(3)-N-T-7MeW-K(Ac)-Pen(3)-AEF-2Nal-THP-E-N-3Pya-Sar-K(C14)-CONH2<br>CCCCCCCCCCCCCC(NCCCC[C@@H](C(C)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O |

TABLE 1M-continued

| Compounds. | |
|---|---|
| SEQ ID | Structure<br>Peptide Sequence<br>Smiles |
| 416 | 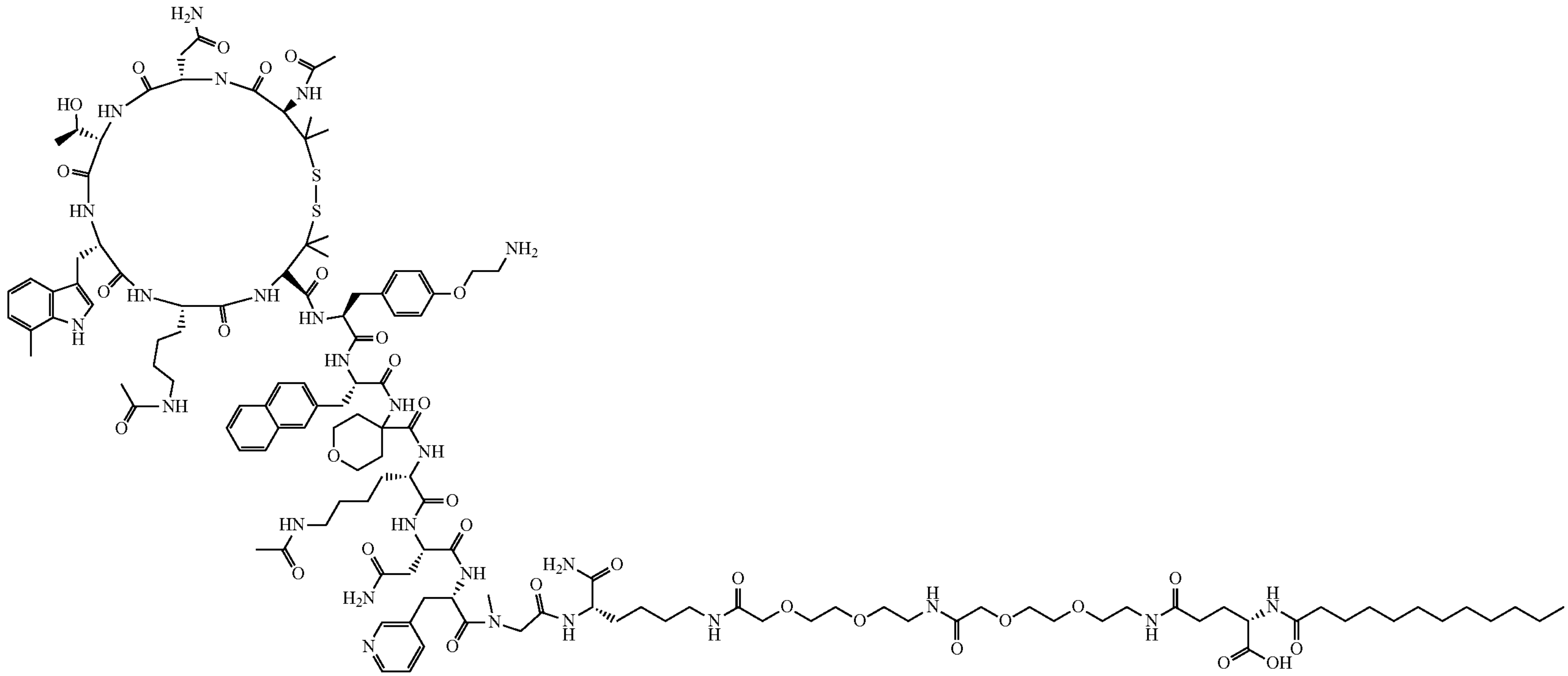<br>MeCO-Pen(3)-N-T-7MeW-K(Ac)-Pen(3)-AEF-2Nal-THP-K(Ac)-N-3Pya-Sar-K(PEG2PEG2gEC12)-CONH2<br>CCCCCCCCCCCCC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCCCNC(C)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)=O)NC(C)=O)NC1=O)=O)=O)=O)=O)=O)=O)=O)=O)=O)=O)=O)C(O)=O)-O |

TABLE 1M-continued
| Compounds. | |
|---|---|
| SEQ ID | Structure<br>Peptide Sequence<br>Smiles |
| 417 | 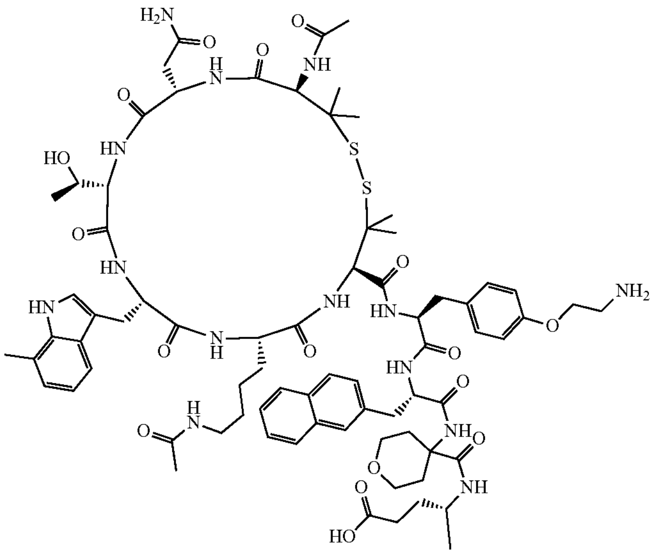 |

TABLE 1M-continued

| Compounds. | |
|---|---|
| SEQ ID | Structure<br>Peptide Sequence<br>Smiles |
| | 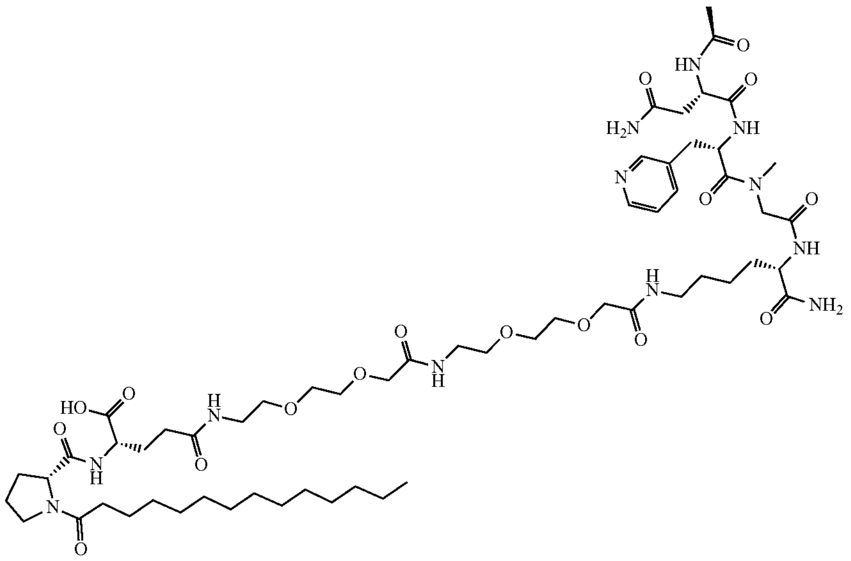<br>MeCO-Pen(3)-N-T-7MeW-K(Ac)-Pen(3)-AEF-2Nal-THP-E-N-3Pya-Sar-K(PEG2PEG2gEDProC14)-CONH2<br>CCCCCCCCCCCCCC(N(CCC1)[C@H]1C(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)=O)NC(C)=O)NC1=O)=O)=O)=O)=O)=O)=O)=O)=O)=O)=O)=O)=O)C(O)=O)=O)=O |

TABLE 1M-continued
| Compounds. | |
|---|---|
| SEQ ID | Structure<br>Peptide Sequence<br>Smiles |
| 418 | 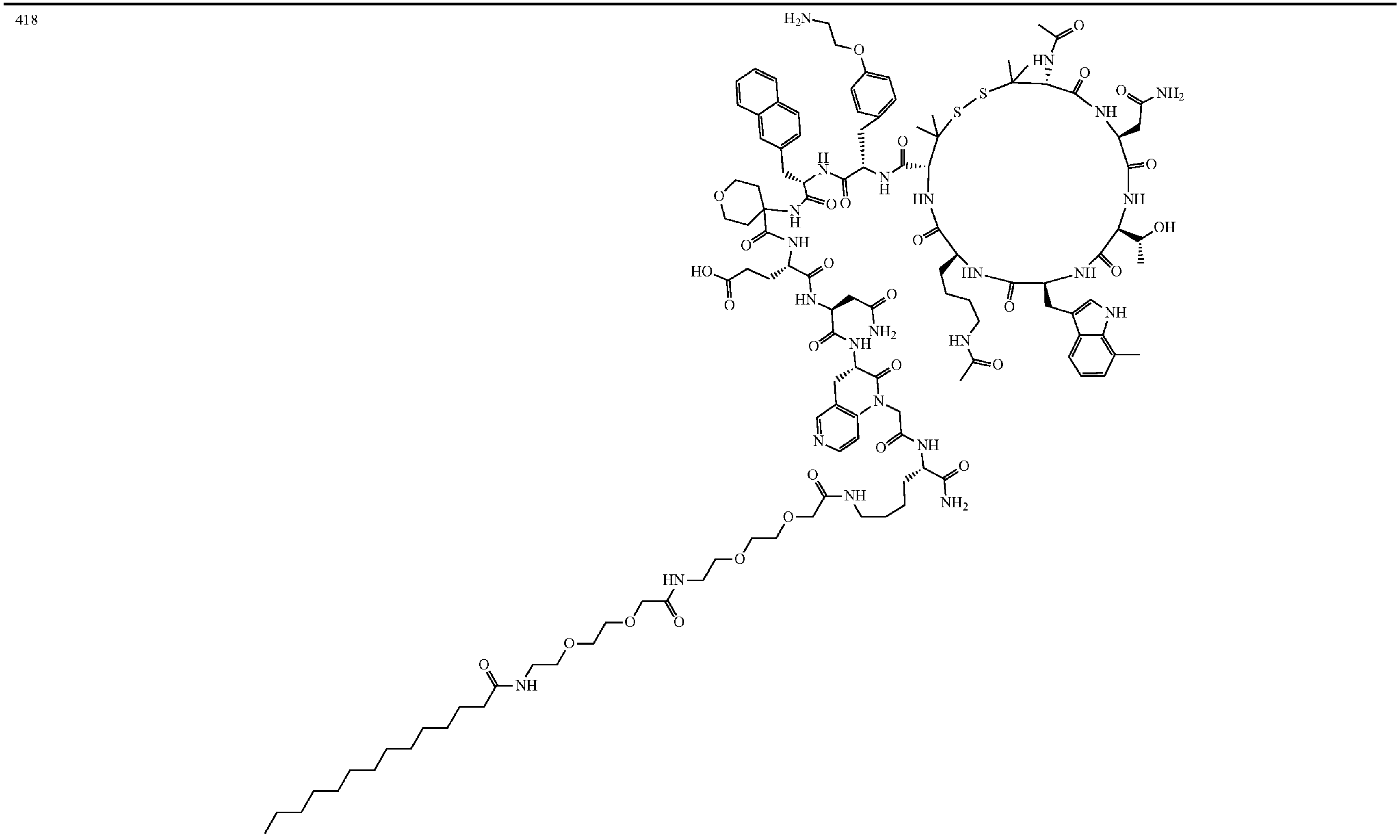 |

TABLE 1M-continued

| Compounds. | |
|---|---|
| SEQ ID | Structure<br>Peptide Sequence<br>Smiles |
| 419 | MeCO-Pen(3)-N-T-7MeW-K(Ac)-Pen(3)-AEF-2Nal-THP-E-N-3Pya-Sar-K(PEG2PEG2C14)-CONH2<br>CCCCCCCCCCCCCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O<br>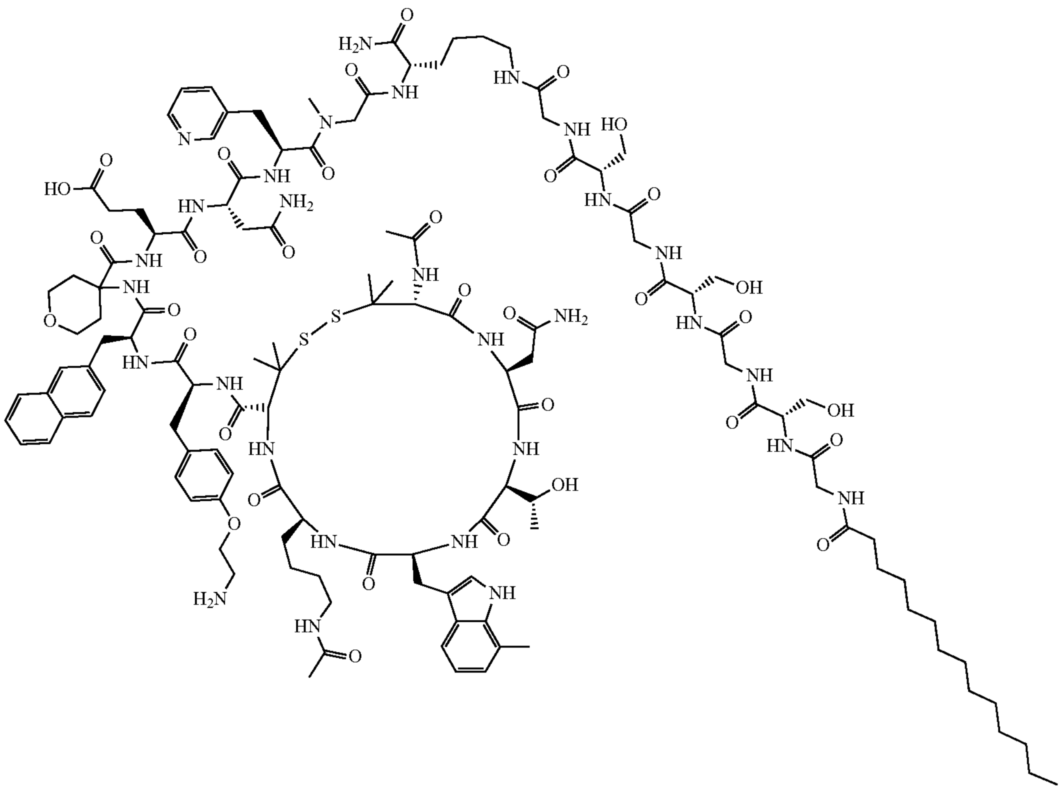 |

TABLE 1M-continued

| Compounds. | |
|---|---|
| SEQ ID | Structure<br>Peptide Sequence<br>Smiles |
| | MeCO-Pen(3)-N-T-7MeW-K(Ac)-Pen(3)-AEF-2Nal-THP-E-N-3Pya-Sar-K(GSGSGSGC14)-CONH2<br>CCCCCCCCCCCCCC(NCC(N[C@@H](CO)C(NCC(N[C@@H](CO)C(NCC(N[C@@H](CO)C(NCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O)=O)=O)=O)=O |
| 420 | 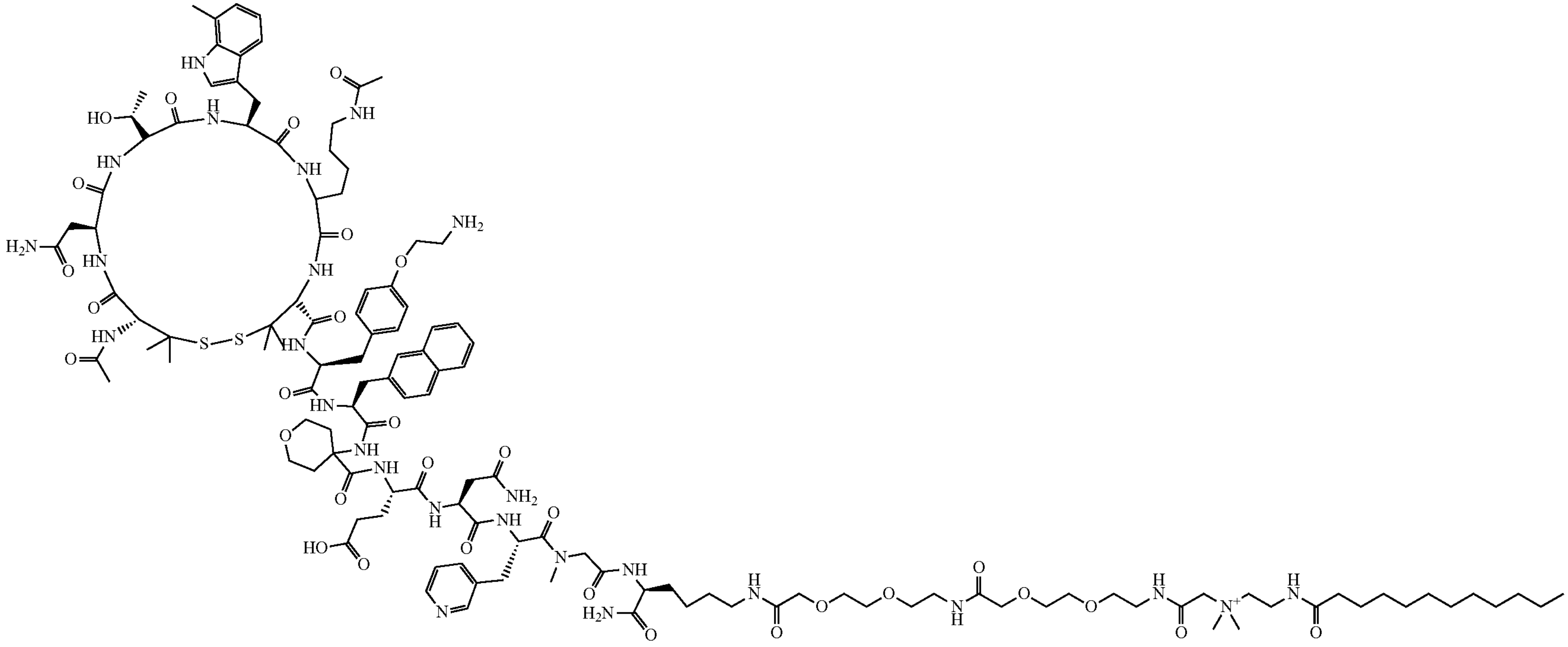 |
| | MeCO-Pen(3)-N-T-7MeW-K(Ac)-Pen(3)-AEF-2Nal-THP-E-N-3Pya-Sar-K(PEG2PEG2SP6C14)-CONH2<br>CCCCCCCCCCCC(NCC[N+](C)(C)CC(NCCOCCOCC(NCCOCCOCC(NCCCC[C |

TABLE 1M-continued

| SEQ ID | Compounds. Structure Peptide Sequence Smiles |
| --- | --- |
| | @@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O |
| 421 | 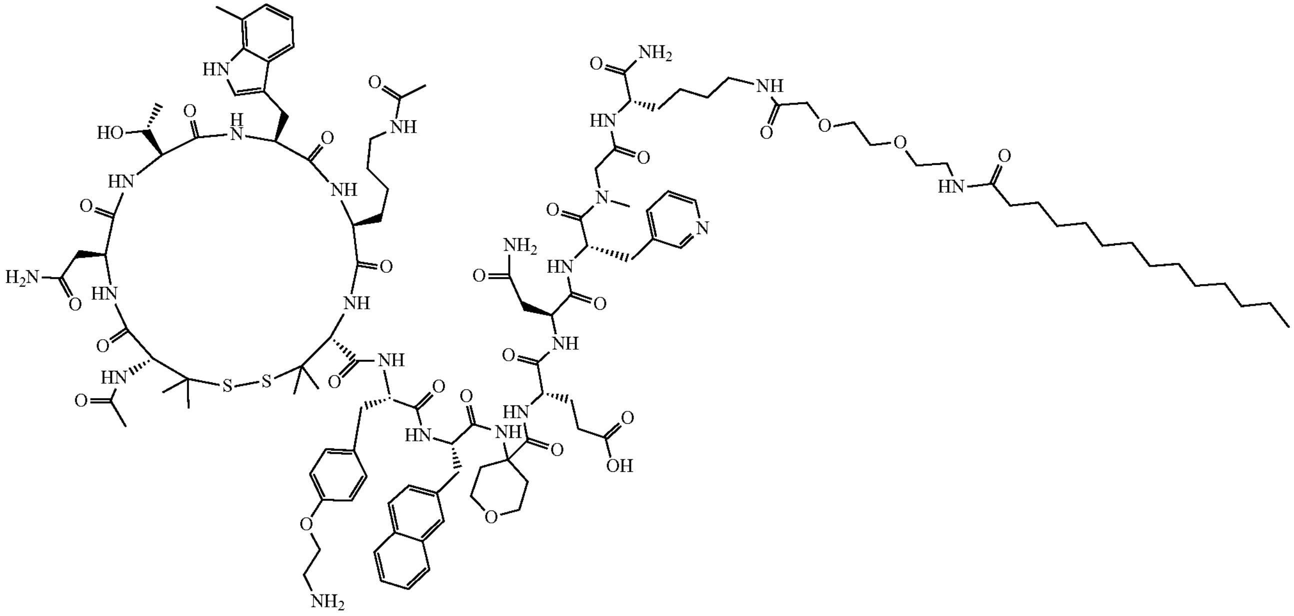 MeCO-Pen(3)-N-T-7MeW-K(Ac)-Pen(3)-AEF-2Nal-THP-E-N-3Pya-Sar-K(PEG2C14)-CONH2 CCCCCCCCCCCCCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O |

TABLE 1M-continued

| Compounds. | |
|---|---|
| SEQ ID | Structure<br>Peptide Sequence<br>Smiles |
| 422 | 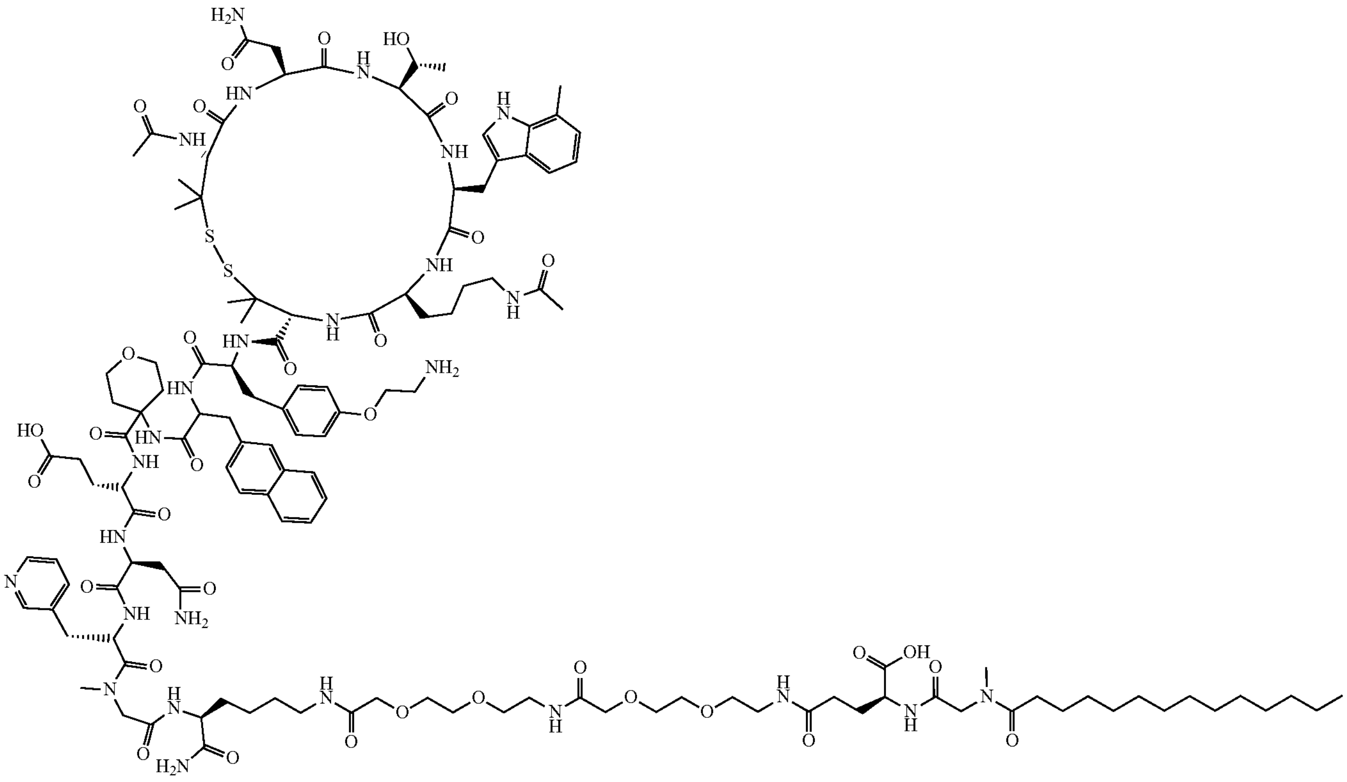<br>MeCO-Pen(3)-N-T-7MeW-K(Ac)-Pen(3)-AEF-2Nal-THP-E-N-3Pya-Sar-K(PEG2PEG2gESarC14)-CONH2<br>CCCCCCCCCCCCCC(N(C)CC(N[C@@H](CCC(NCCOCCOCC(NCCOCCOCC(NCCCC[C@@H](C(N)=O)NC(CN(C)C([C@H](Cc1cnccc1)NC([C@H](CC(N)=O)NC([C@H](CCC(O)=O)NC(C1(CCOCC1)NC([C@H](Cc1cc2ccccc2cc1)NC([C@H](Cc(cc1)ccc1OCCN)NC([C@H](C(C)(C)SSC(C)(C)[C@@H](C(N[C@@H](CC(N)=O)C(N[C@@H]([C@@H](C)O)C(N[C@@H](Cc1c[nH]c2c1cccc2C)C(N[C@H]1CCCCNC(C)=O)=O)=O)=O)=O)NC(C)=O)NC1=O)=O)=O)=O)=O)=O)=O)=O)=O)=O)=O)=O)C(O)=O)=O)=O |

TABLE 1M-continued
| Compounds. | |
|---|---|
| SEQ ID | Structure<br>Peptide Sequence<br>Smiles |
| 423 | 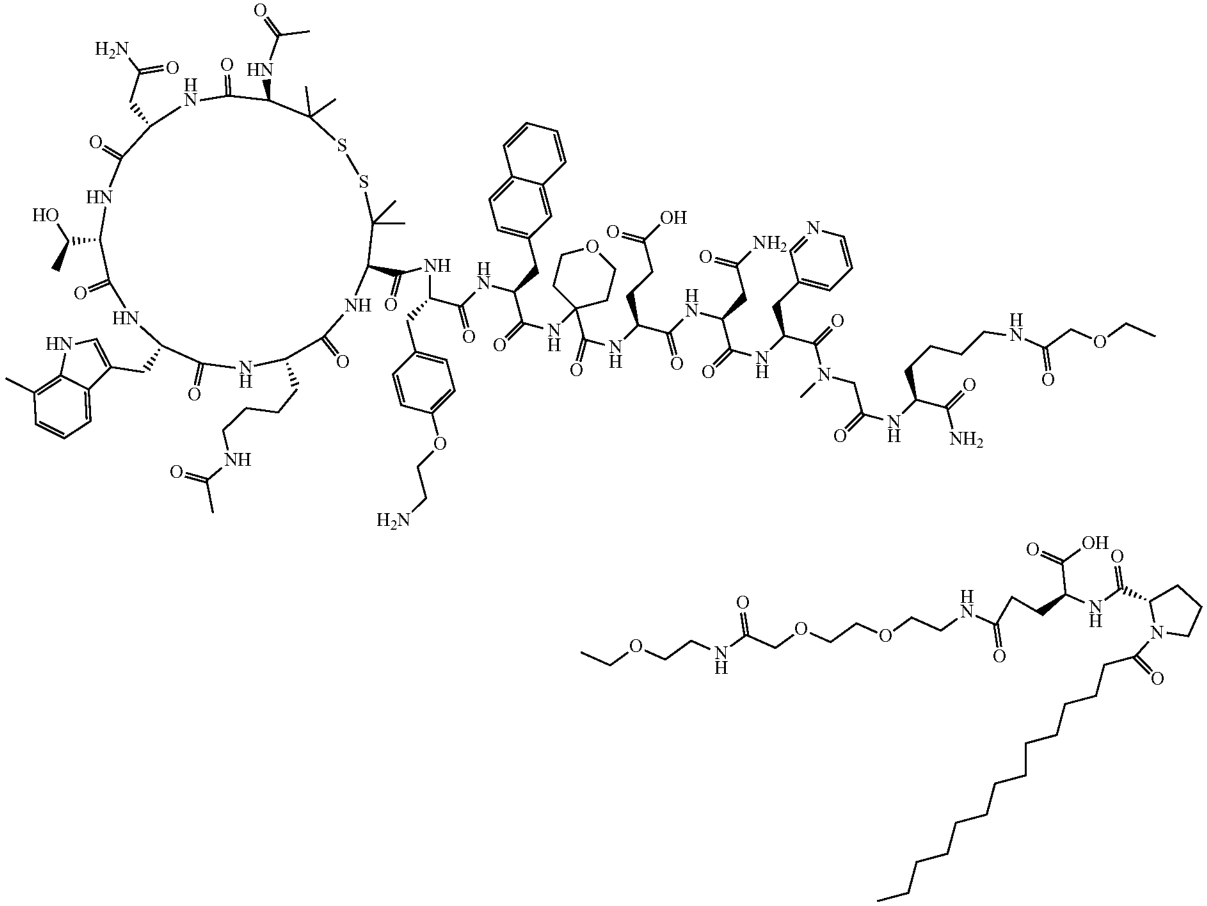<br>MeCO-Pen(3)-N-T-7MeW-K(Ac)-Pen(3)-AEF-2Nal-THP-E-N-3Pya-Sar-K(PEG2PEG2gEProC14)-CONH2<br>CCCCCCCCCCCCCC(N(CCC1)[C@@H]1C(N[C@@H](CCC(NCCOCCOCC(NCCOCCOCC(NCCCC[C@@H](C(N)=O)NC(CN(C)C([C@H](Cc1cnccc1)NC([C |

TABLE 1M-continued

| SEQ ID | Compounds. Structure Peptide Sequence Smiles |
|---|---|
| | @H](CC(N)=O)NC([C@H](CCC(O)=O)NC(C1(CCOCC1)NC([C@H](Cc1cc2cccc c2cc1)NC([C@H](Cc(cc1)ccc1OCCN)NC([C@H](C(C)(C)SSC(C)(C)[C@@H](C (N[C@@H](CC(N)=O)C(N[C@@H]([C@@H](C)O)C(N[C@@H](Cc1c[nH]c2c1c ccc2C)C(N[C@H]1CCCCNC(C)=O)=O)=O)=O)=O)NC(C)=O)NC1=O)=O)=O)= O)=O)=O)=O)=O)=O)=O)=O)=O)C(O)=O)=O)=O |
| 424 | 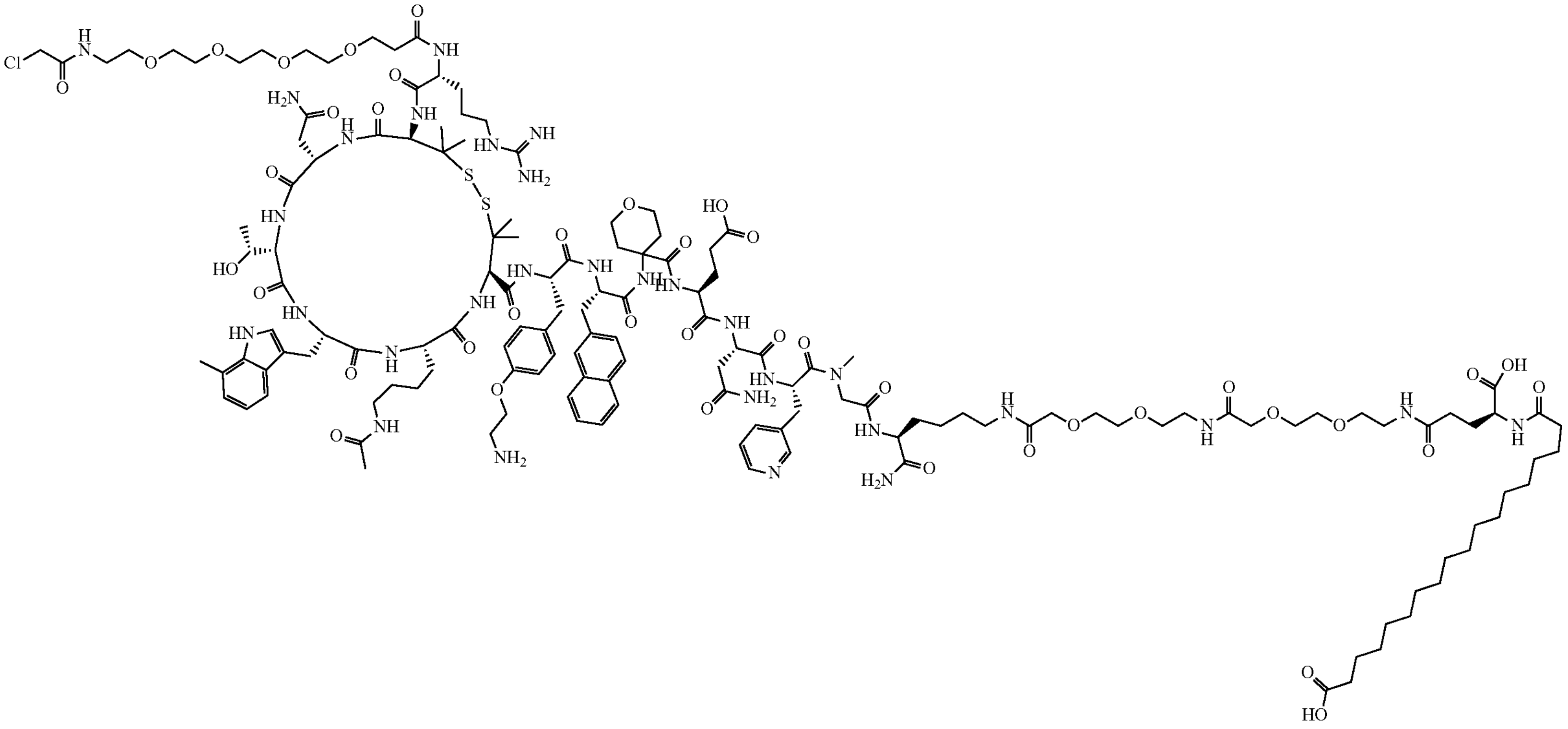 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=N)N)NC(=O)CCOCCOCCOCCOCCNC(=O)CCl)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(N)=O)CCOCC2)NC1=O] ClAcPEG4CO-r-Pen(3)-N-T-7MeW-K(Ac)-Pen(3)-AEF-2Nal-THP-E-N-3Pya-Sar-K(PEG2PEG2gEC18OH)-CONH2 C[C@H]([C@@H](C(N[C@@H](Cc1c[nH]c2c1cccc2C)C(N[C@@H](CCCCNC (C)=O)C(N[C@@H](C(C)(C)SSC(C)(C)[C@@H](C(N[C@H]1CC(N)=O)=O)NC ([C@@H](CCCNC(N)=N)NC(CCOCCOCCOCCOCCNC(CCl)=O)=O)=O)C(N[C@ |

TABLE 1M-continued

| Compounds. | |
|---|---|
| SEQ ID | Structure<br>Peptide Sequence<br>Smiles |
| | @H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)NC1=O)O |
| 425 | 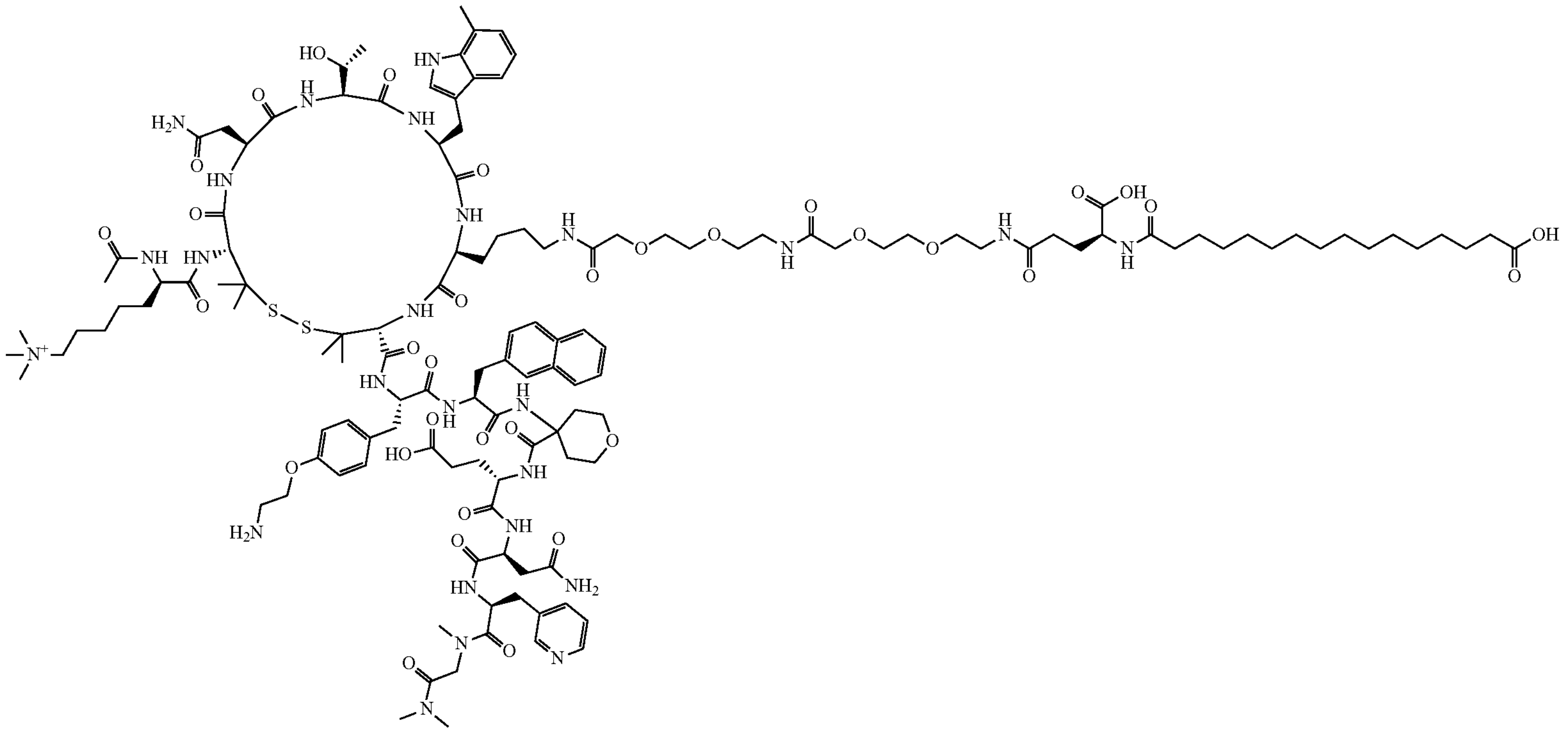<br>MeCO-hk(Me)3-Pen(3)-N-T-7MeW-K(PEG2PEG2gEC18OH)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(COCCOCCNC(COCCOCCNC(CC[C@@H](C(O)=O)NC(CCCCCCCCCCCCCCCC(O)=O)=O)=O)=O)=O)=O)C(N[C@@H](C(C)(C)SSC(C)(C)[C@@H](C(N[C@H]1CC(N)=O)=O)NC([C@@H](CCCCC[N+](C)(C)C)NC(C)=O)=O)C(N[C@@H](Cc(cc |

TABLE 1M-continued

| SEQ ID | Compounds. Structure Peptide Sequence Smiles |
|---|---|
| | 2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N(C)C)=O)=O)=O)=O)=O)=O)=O)=O)=O)=O)NC1=O)O |
| 426 | 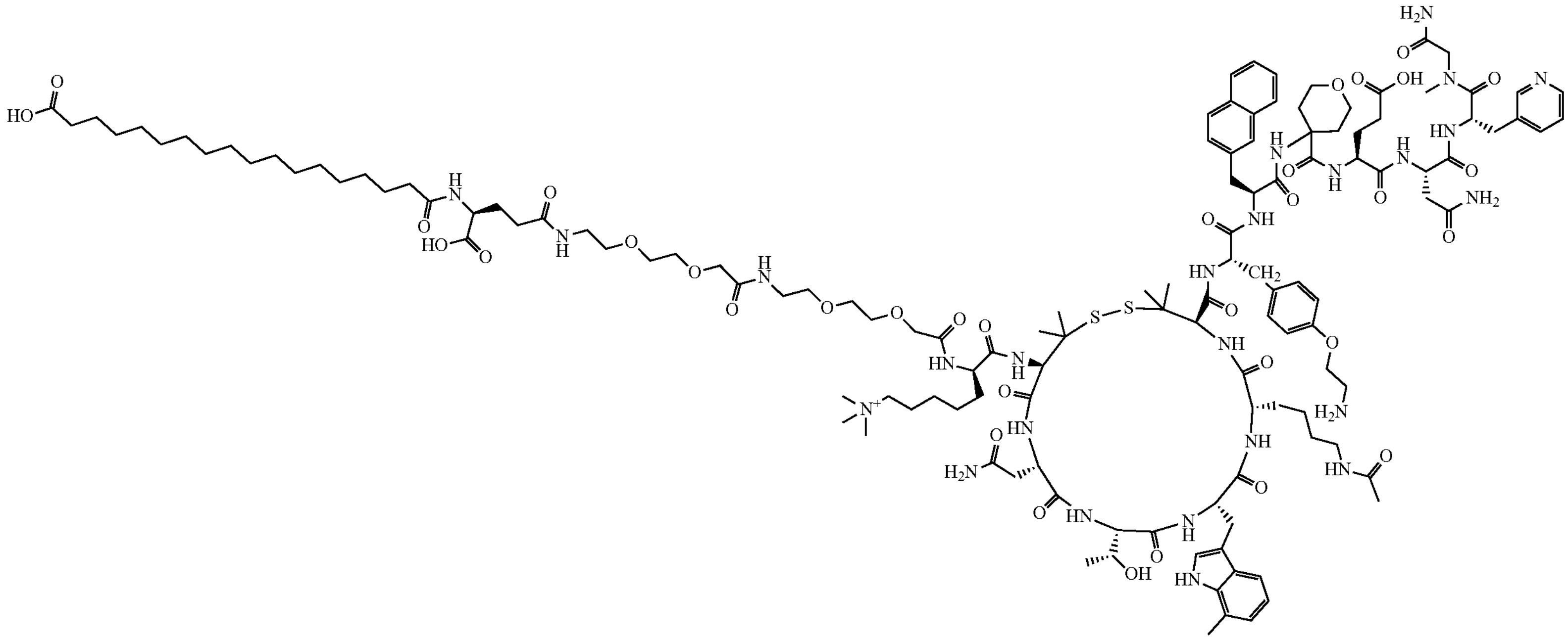 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCC[N+](C)(C)C)NC(=O)COCCOCCNC(=O)COCCOCCNC(=O)CC[C@H](NC(=O)CCCCCCCCCCCCCCCCC(=O)O)C(=O)O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O] HOC18gEPEG2PEG2CO-hk(Me)3-Pen(3)-N-T-7MeW-K(Ac)-Pen(3)-AEF-2Nal-THP-E-N-3Pya-Sar-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCC[N+](C)(C)C)NC(COCCOCCNC(COCCOCCNC(CC[C@@H](C(O)=O)NC(CCCCCCCCCCCCCCCCCC(O)=O)=O)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)NC1=O)O |

TABLE 1M-continued
| SEQ ID | Compounds. Structure Peptide Sequence Smiles |
|---|---|
| 427 | 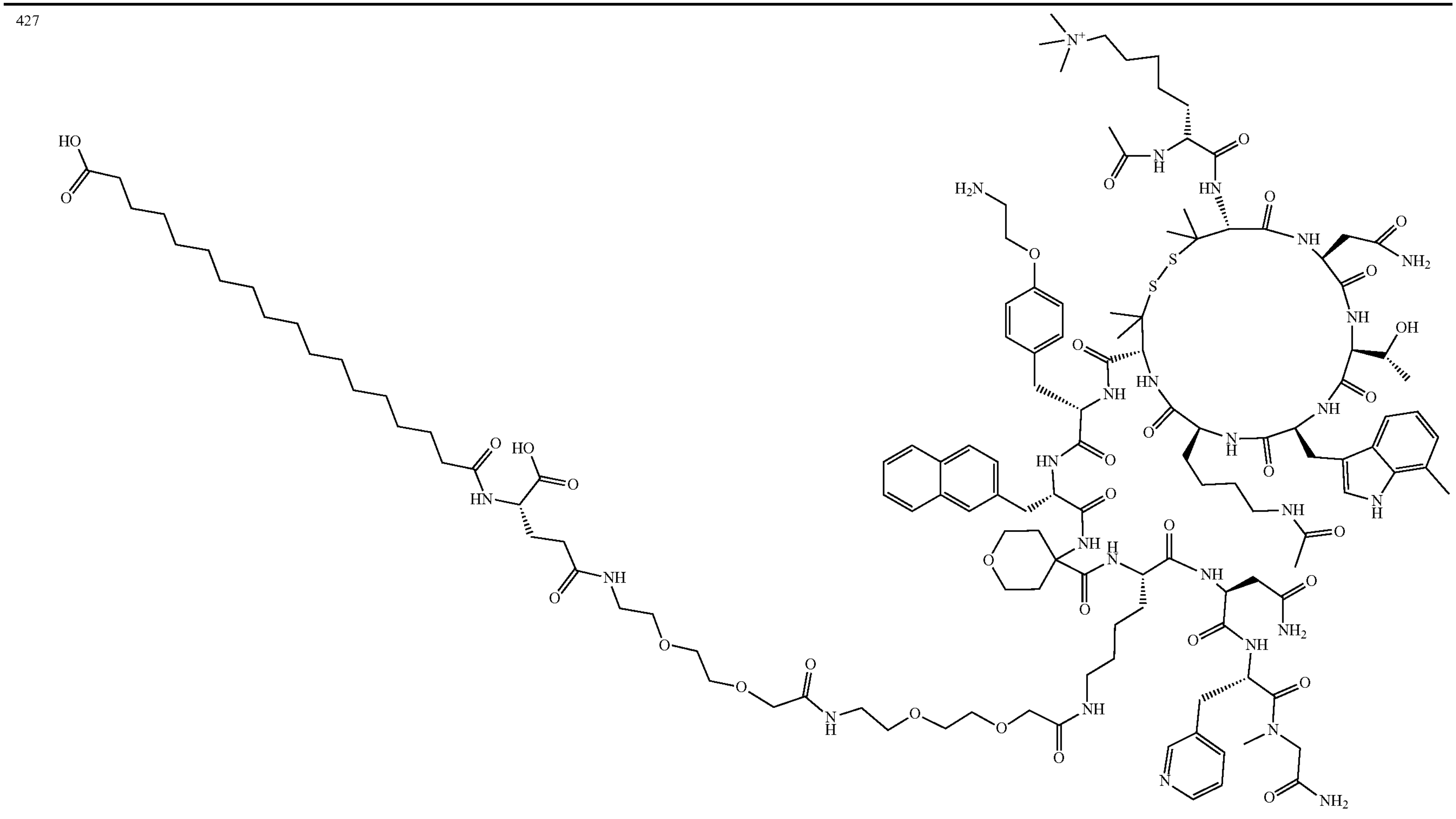 MeCO-hk(Me)3-Pen(3)-N-T-7MeW-K(Ac)-Pen(3)-AEF-2Nal-THP-K(PEG2PEG2gEC18OH)-N-3Pya-Sar-CONH2 |

TABLE 1M-continued

| SEQ ID | Compounds. Structure Peptide Sequence Smiles |
|---|---|
| | C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCC[N+](C)(C)C)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(COCCOCCNC(COCCOCCNC(CC[C@@H](C(O)=O)NC(CCCCCCCCCCCCCCCCC(O)=O)=O)=O)=O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |
| 428 | 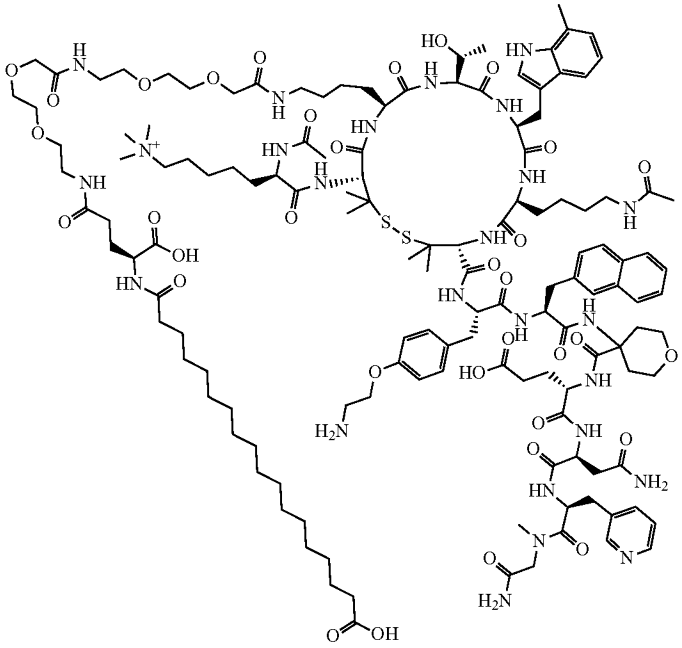 [SMILES: CC(=O)NCCCC[C@@H]1NC(=O)[C@H](Cc2c[nH]c3c(C)cccc23)NC(=O)[C@H]([C@@H](C)O)NC(=O)[C@H](CCCCNC(=O)COCCOCCNC(=O)COCCOCCNC(=O)CC[C@H](NC(=O)CCCCCCCCCCCCCCCCC(=O)O)C(=O)O)NC(=O)[C@@H](NC(=O)[C@@H](CCCCC[N+](C)(C)C)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O] MeCO-hk(Me)3-Pen(3)-K(PEG2PEG2gEC18OH)-T-7MeW-K(Ac)-Pen(3)-AEF-2Nal-THP-E-N-3Pya-Sar-CONH2A C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)NC([C@@H](CCCCC[N+](C)(C)C)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC |

TABLE 1M-continued

| SEQ ID | Compounds. Structure Peptide Sequence Smiles |
|---|---|
| | (N)=O)=O)=O)=O)=O)=O)=O)=O)=O)=O)=O)NC1=O)O |
| 429 | 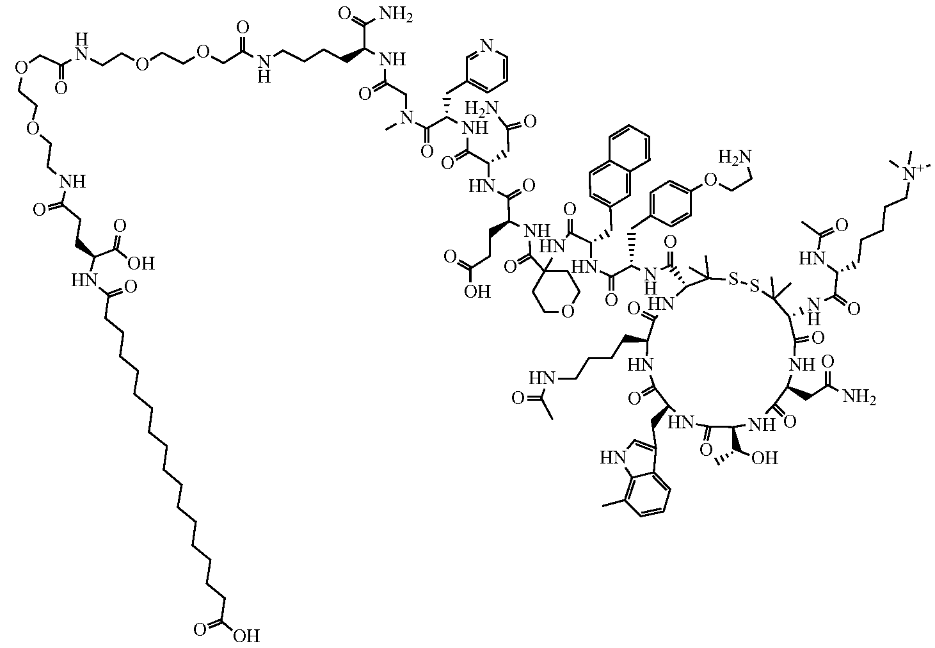 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCC[N+](C)(C)C)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(N)=O)CCOCC2)NC1=O] MeCO-hk(Me)3-Pen(3)-N-T-7MeW-K(Ac)-Pen(3)-AEF-2Nal-THP-E-N-3Pya-Sar-K(PEG2PEG2C18OH)-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCC[N+](C)(C)C)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 430 | 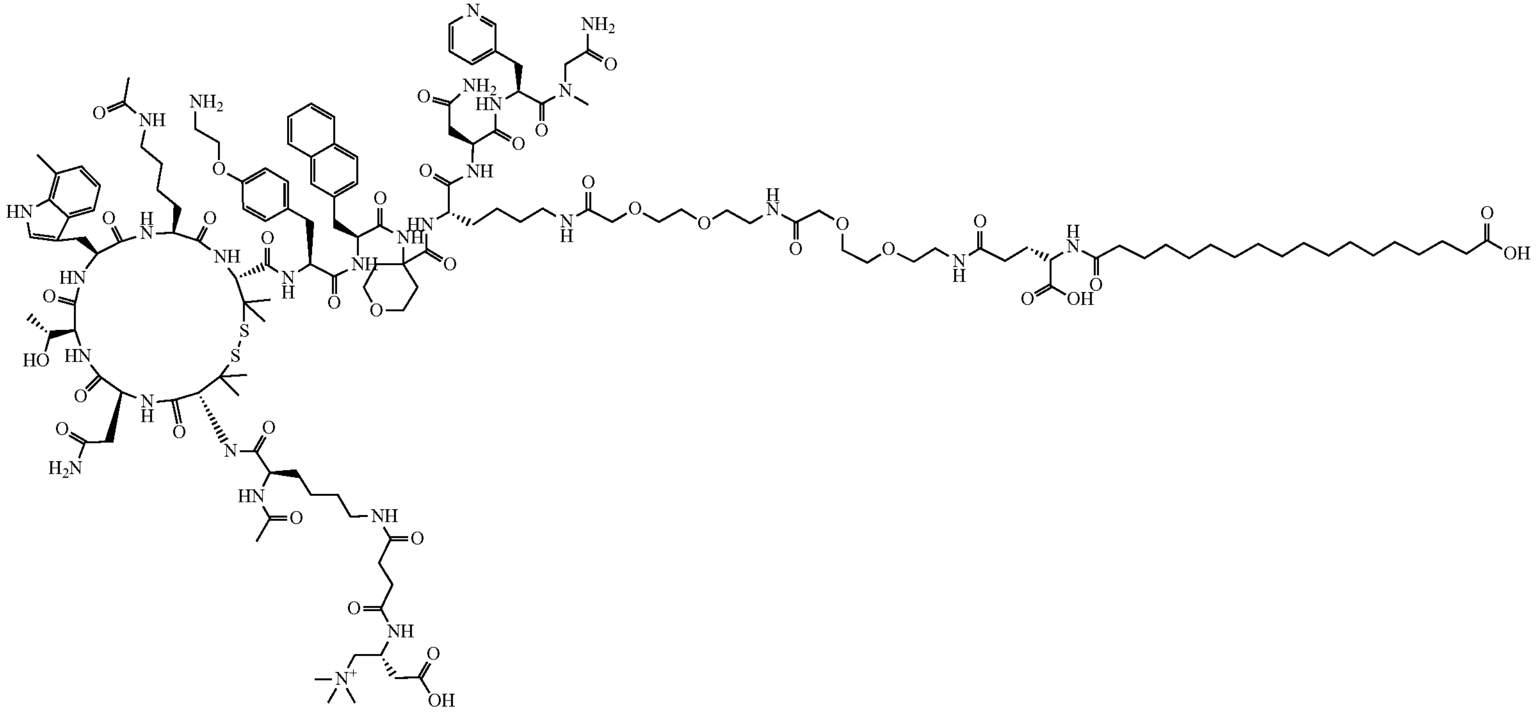<br>MeCO-k(d)-Pen(3)-N-T-7MeW-K(Ac)-Pen(3)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)=O)=O)=O)=O)=O)NC1=O)O |

TABLE 1M-continued
| SEQ ID | Compounds. Structure Peptide Sequence Smiles |
|---|---|
| 431 | 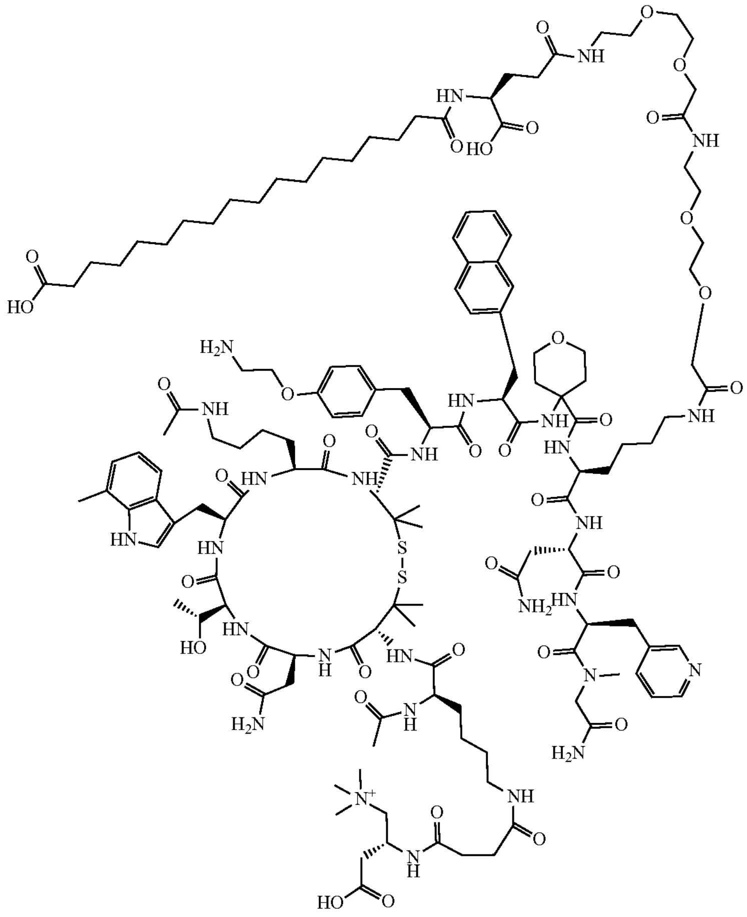 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)CCC(=O)N[C@H](CC(=O)O)C[N+](C)(C)C)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(=O)N[C@@H](CC(N)=O)C(=O)N[C@@H](Cc3cccnc3)C(=O)N(C)CC(N)=O)CCOCC2)NC1=O] MeCO-k(d)-Pen(3)-N-T-7MeW-K(Ac)-Pen(3)-AEF-2Nal-THP-K(PEG2PEG2gEC18OH)-N-3Pya-Sar-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC |

TABLE 1M-continued

| SEQ ID | Compounds. Structure Peptide Sequence Smiles |
|---|---|
| | ([C@@H](CCCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N[C@@H](CC(N)=O)C(N[C@@H](Cc2cnccc2)C(N(C)CC(N)=O)=O)=O)=O)=O)=O)=O)=O)=O)=O)NC1=O)O |
| 432 | 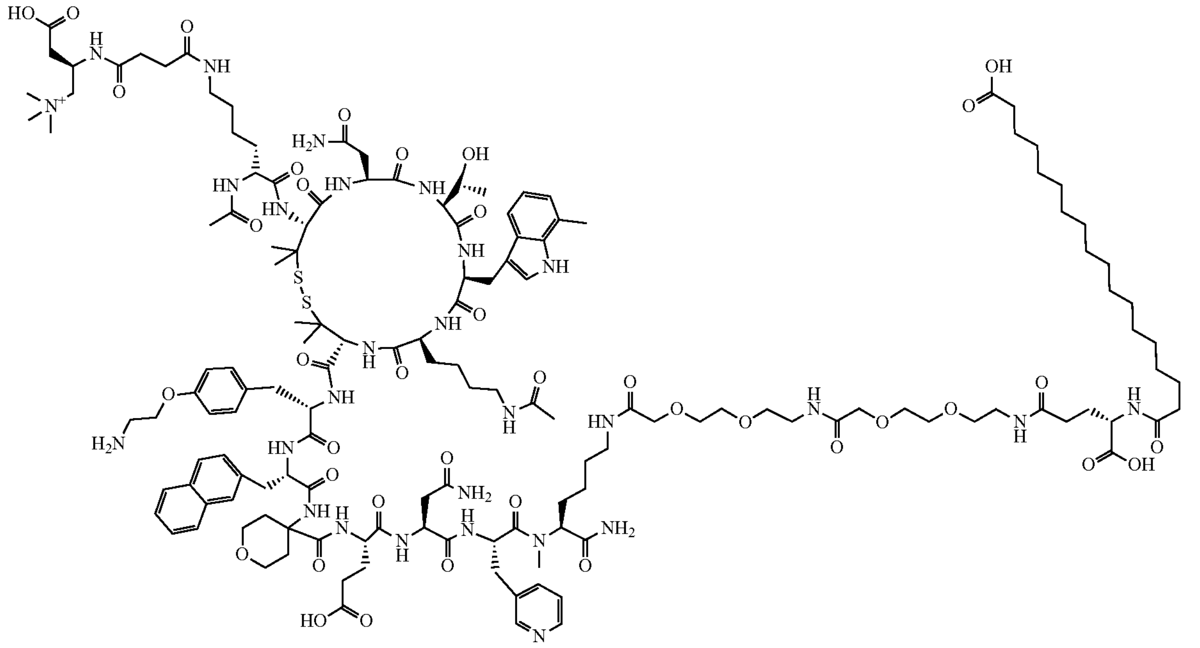<br>MeCO-k(d)-Pen(3)-N-T-7MeW-K(Ac)-Pen(3)-AEF-2Nal-THP-E-N-3Pya-NMeK(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)[C@@H](CCCCNC(COCCOCCNC(COCCOCCNC(CC[C@@H](C(O)=O) |

TABLE 1M-continued
| SEQ ID | Compounds. Structure Peptide Sequence Smiles |
|---|---|
| | NC(CCCCCCCCCCCCCCCCCC(O)=O)=O)=O)=O)=O)=O)C(N)=O)=O)=O)=O)=O)=O)=O)=O)=O)=O)=O)=O)NC1=O)O |
| 433 | 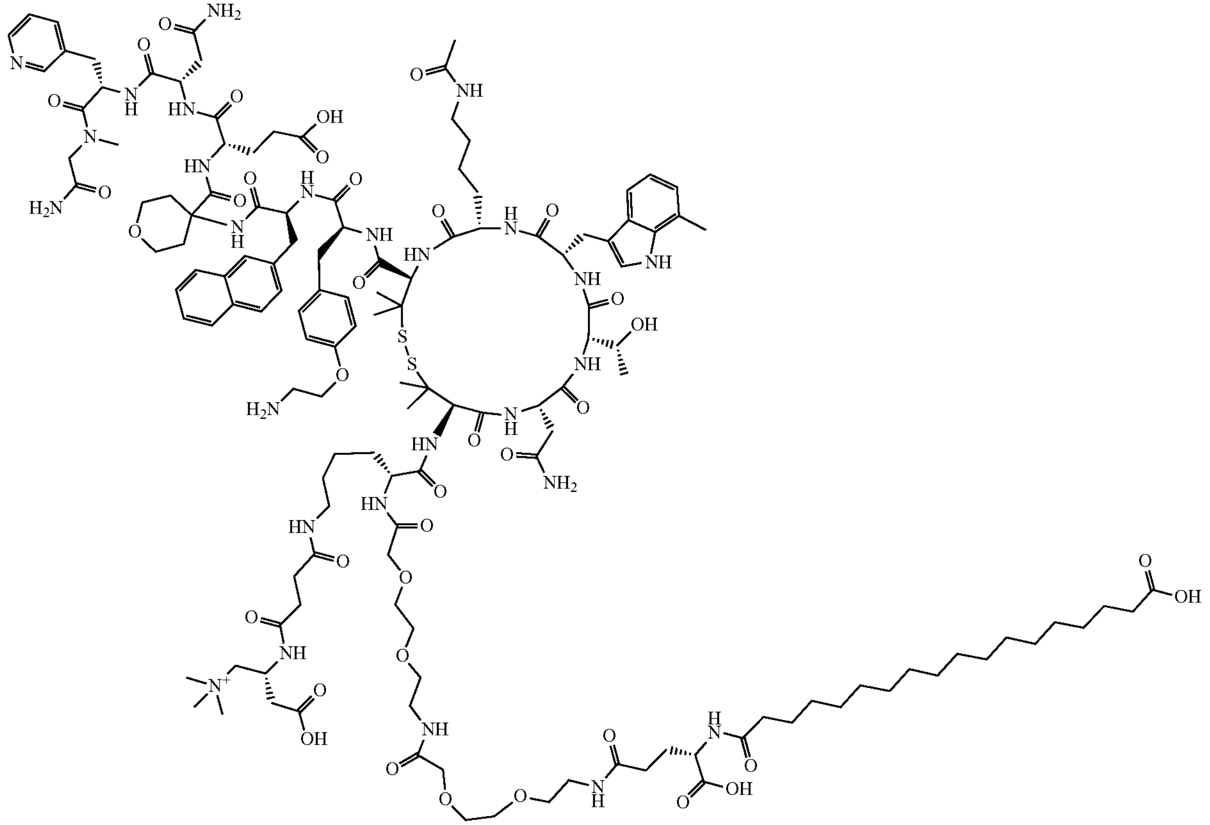 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)CCC(=O)N[C@H](CC(=O)O)C[N+](C)(C)C)NC(=O)COCCOCCNC(=O)COCCOCCNC(=O)CC[C@H](NC(=O)CCCCCCCCCCCCCCCCC(=O)O)C(=O)O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O] |

TABLE 1M-continued

| Compounds. | |
|---|---|
| SEQ ID | Structure<br>Peptide Sequence<br>Smiles |
| | HOC18gEPEG2PEG2CO-k(d)-Pen(3)-N-T-7MeW-K(Ac)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@H](CC(O)=O)C[N+](C)(C)C)=O)=O)NC(COCCOCCNC(COCCOCCNC(CC[C@@H](C(O)=O)NC(CCCCCCCCCCCCCCCCC(O)=O)=O)=O)=O)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued
| Compounds. | |
| --- | --- |
| SEQ ID | Structure<br>Peptide Sequence<br>Smiles |
| 434 | 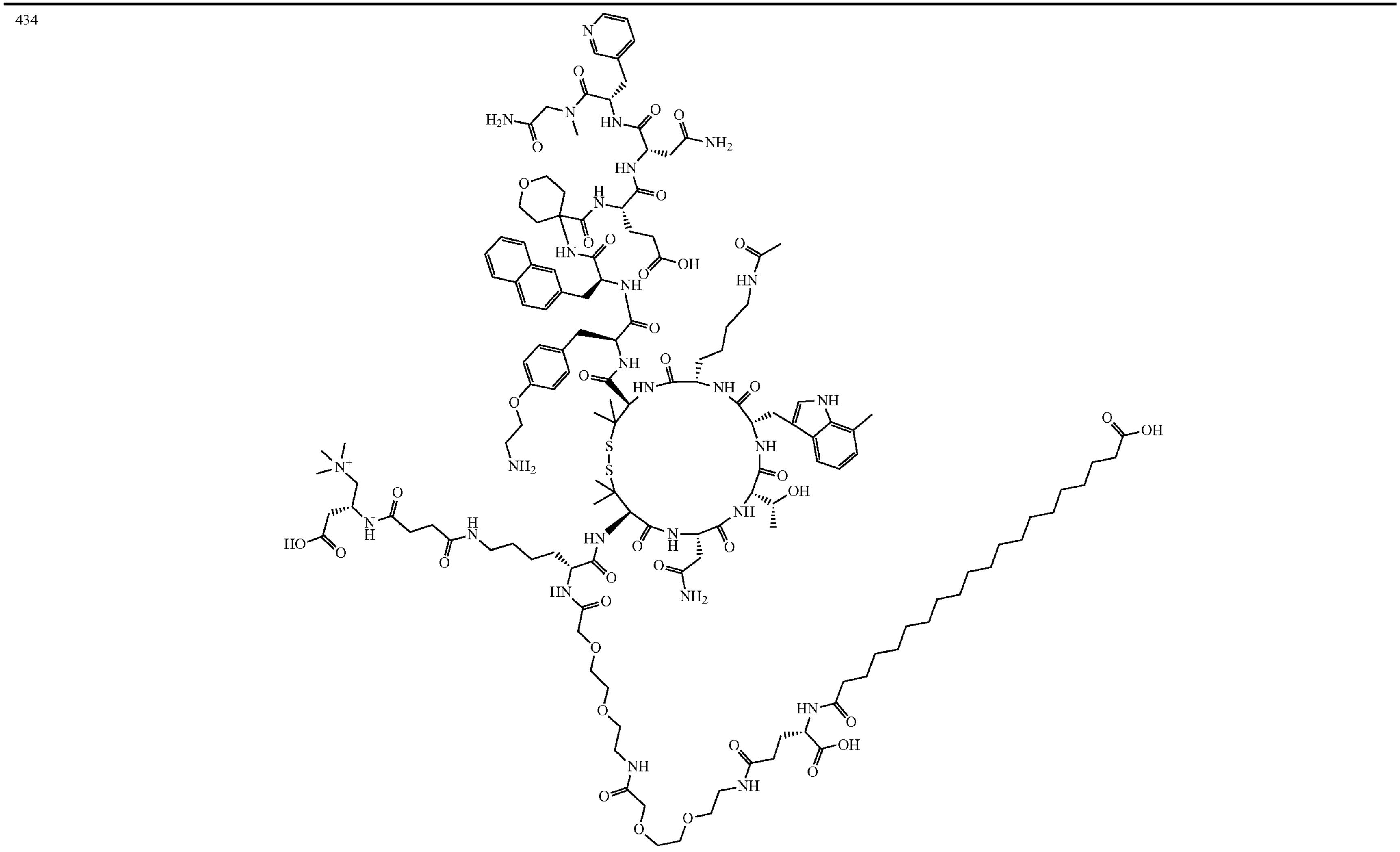 |

TABLE 1M-continued

| Compounds. | |
|---|---|
| SEQ ID | Structure<br>Peptide Sequence<br>Smiles |
| 435 | HOC20gEPEG2PEG2CO-k(d)-Pen(3)-N-T-7MeW-K(Ac)-Pen(3)-AEF-2Nal-THP-<br>E-N-3Pya-Sar-CONH2<br>C[C@H]([C@@H](C(N[C@@H](Cc1c[nH]c2c1cccc2C)C(N[C@@H](CCCCNC<br>(C)=O)C(N[C@@H](C(C)(C)SSC(C)(C)[C@@H](C(N[C@H]1CC(N)=O)=O)NC<br>([C@@H](CCCCNC(CCC(N[C@H](CC(O)=O)C[N+](C)(C)C)=O)=O)NC(COCCO<br>CCNC(COCCOCCNC(CC[C@@H](C(O)=O)NC(CCCCCCCCCCCCCCCCCCC<br>(O)=O)=O)=O)=O)=O)=O)=O)C(N[C@@H](Cc(cc2)ccc2OCCN)C(N[C@@H](Cc2cc3<br>ccccc3cc2)C(NC2(CCOCC2)C(N[C@@H](CCC(O)=O)C(N[C@@H](CC(N)=O)C<br>(N[C@@H](Cc2cnccc2)C(N(C)CC(N)=O)=O)=O)=O)=O)=O)=O)=O)=O)=O)=O)<br>NC1=O)O<br>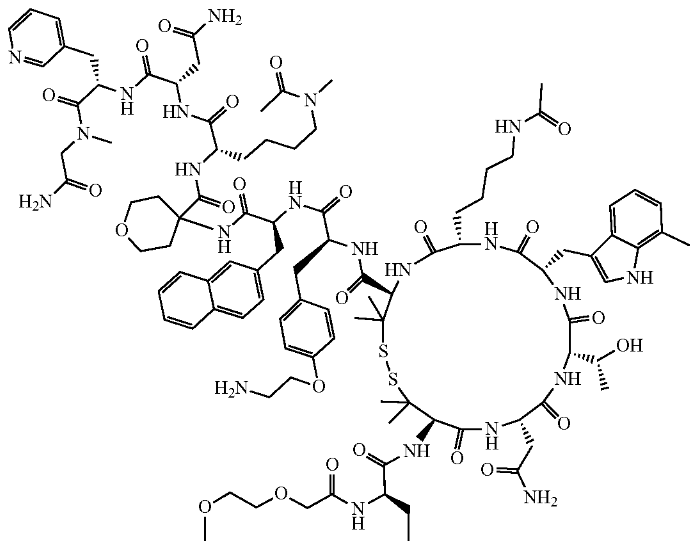 |

TABLE 1M-continued

| Compounds. | |
|---|---|
| SEQ ID | Structure<br>Peptide Sequence<br>Smiles |
| | 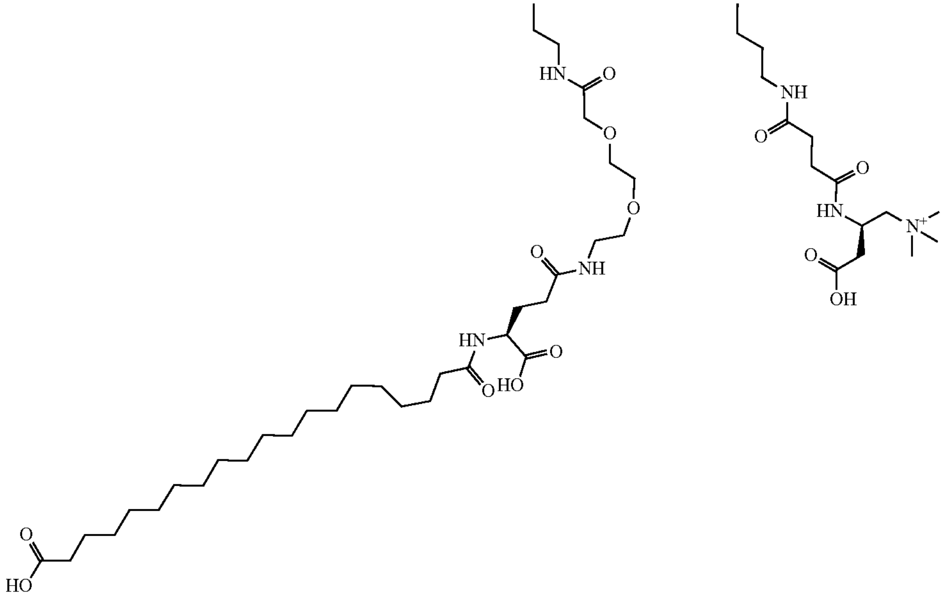<br>HOC20gEPEG2PEG2CO-k(d)-Pen(3)-N-T-7MeW-K(Ac)-Pen(3)-AEF-2Nal-THP-K(NMeAc)-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@H](CC(O)=O)C[N+](C)(C)C)=O)=O)NC(COCCOCCNC(COCCOCCNC(CC[C@@H](C(O)=O)NC(CCCCCCCCCCCCCCCCCCC(O)=O)=O)=O)=O)=O)=O)C(N[C@@H](Cc(cc2)ccc2OCCN)C(N[C@@H](Cc2cc3ccccc3cc2)C(NC2(CCOCC2)C(N[C@@H](CCCCN(C)C(C)=O)C(N[C@@H](CC(N)=O)C(N[C@@H](Cc2cnccc2)C(N(C)CC(N)=O)=O)=O)=O)=O)=O)=O)=O)=O)=O)=O)NC1=O)O |

TABLE 1M-continued

| Compounds. | |
|---|---|
| SEQ ID | Structure<br>Peptide Sequence<br>Smiles |
| 436 | 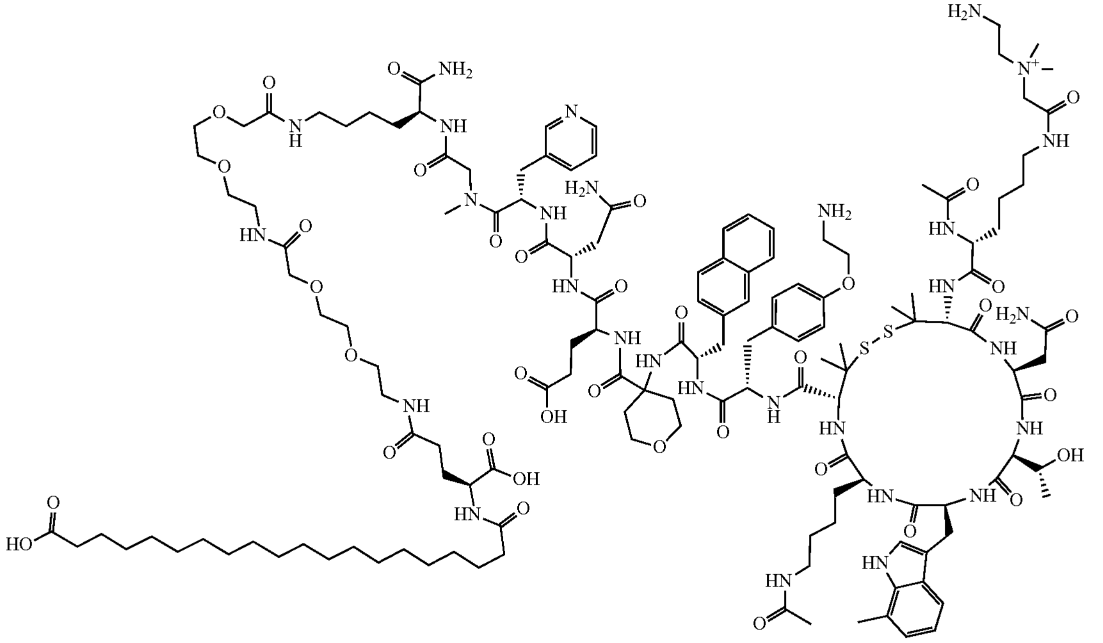 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)C[N+](C)(C)CCN)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(=O)N[C@@H](CCCCNC(=O)COCCOCCNC(=O)COCCOCCNC(=O)CC[C@H](NC(=O)CCCCCCCCCCCCCCCCCCC(=O)O)C(=O)O)C(N)=O)CCOCC2)NC1=O]<br>MeCO-k(SP6)-Pen(3)-N-T-7MeW-K(Ac)-Pen(3)-AEF-2Nal-THP-E-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(C[N+](C)(C)CCN)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCCCC(O)=O)=O)=O)=O)=O)=O)C(N)=O)=O)=O)=O)=O)=O)=O)=O)=O)=O)=O)NC1=O)O |

TABLE 1M-continued

| SEQ ID | Compounds. Structure Peptide Sequence Smiles |
|---|---|
| 437 | 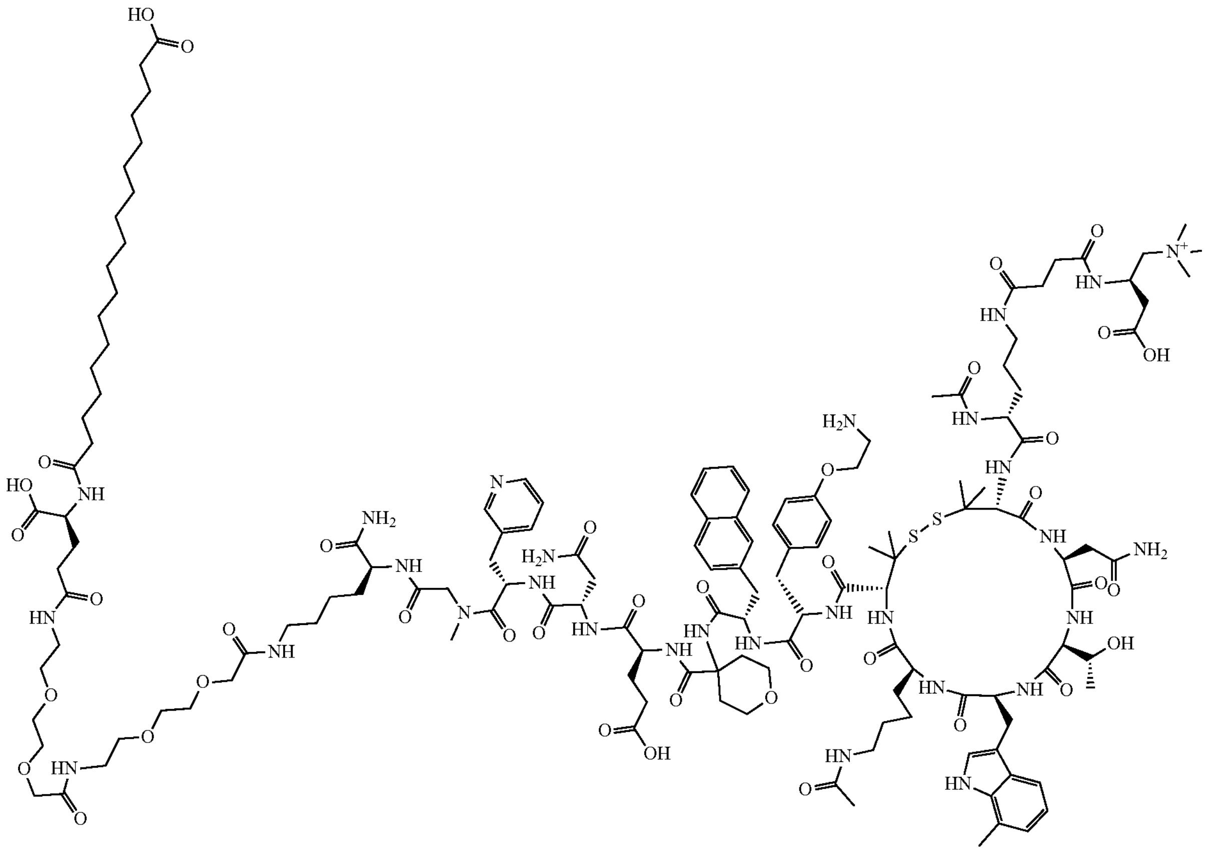 MeCO-orn(d)-Pen(3)-N-T-7MeW-K(Ac)-Pen(3)-AEF-2Nal-THP-E-N-3Pya-Sar-K(PEG2PEG2gEC18OH)-CONH2 C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C |

TABLE 1M-continued
Compounds.
| SEQ ID | Structure<br>Peptide Sequence<br>Smiles |
|---|---|
| 438 | (N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)=O)C(N)=O)=O)=O)=O)=O)=O)=O)=O)=O)=O)=O)=O)=O)NC1=O)O<br>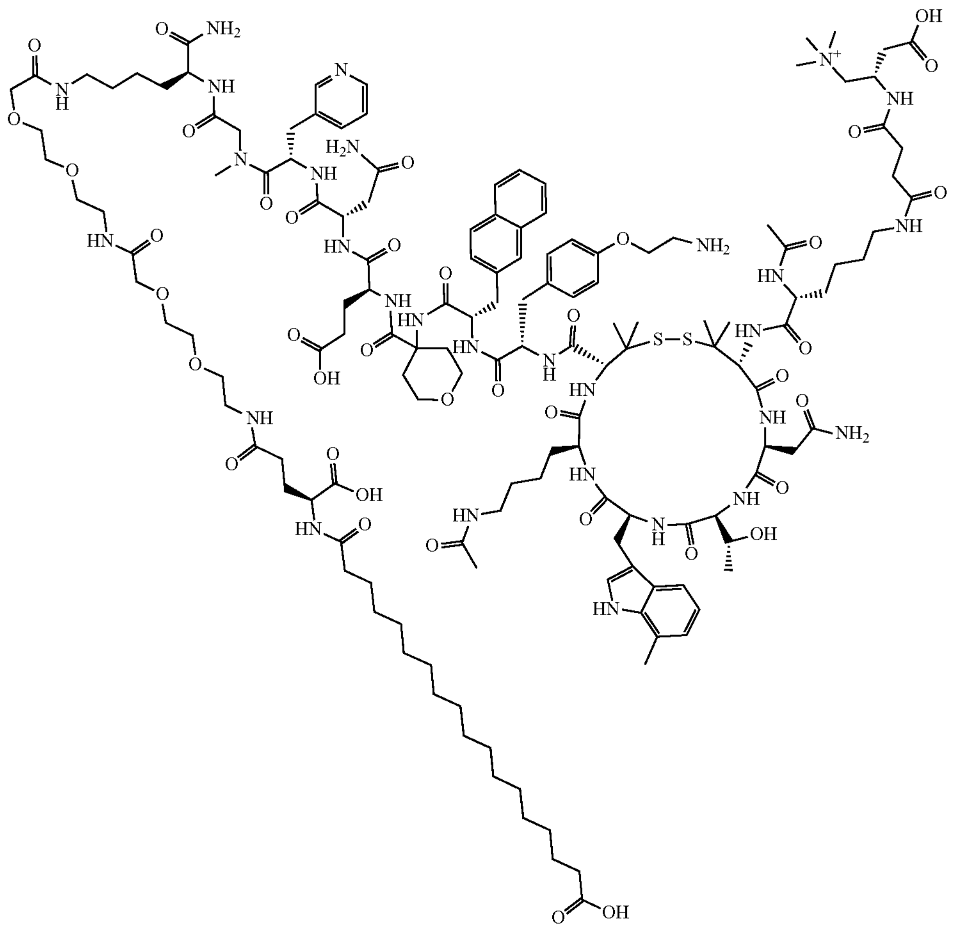 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)CCC(=O)N[C@@H](CC(=O)O)C[N+](C)(C)C)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(=O)N[C@@H](CCCCNC(=O)COCCOCCNC(=O)COCCOCCNC(=O)CC[C@H](NC(=O)CCCCCCCCCCCCCCCCC(=O)O)C(=O)O)C(N)=O)CCCOCC2)NC1=O] |

TABLE 1M-continued

| Compounds. | |
|---|---|
| SEQ ID | Structure<br>Peptide Sequence<br>Smiles |
| 439 | MeCO-k(D)-Pen(3)-N-T-7MeW-K(Ac)-Pen(3)-AEF-2Nal-THP-E-N-3Pya-Sar-K(PEG2PEG2gEC18OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCC(O)=O)=O)=O)=O)=O)C(N)=O)=O)=O)=O)=O)=O)=O)=O)=O)=O)=O)=O)NC1=O)O<br>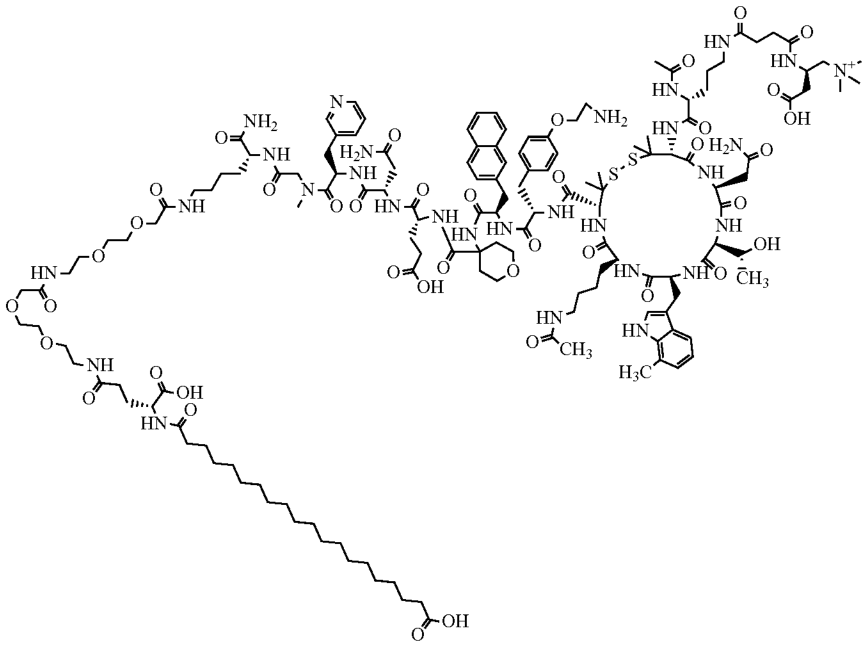 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCNC(=O)CCC(=O)N[C@H](CC(=O)O)C[N+](C)(C)C)NC(C)=O)C(C)(C)SSC(C)(C)[C@@H](C(=O)N[C@@H](Cc2ccc(OCCN)cc2)C(=O)N[C@H](Cc2ccc3ccccc3c2)C(=O)NC2(C(=O)N[C@H](CCC(=O)O)C(=O)N[C@@H](CC(N)=O)C(=O)N[C@H](Cc3cccnc3)C(=O)N(C)CC(=O)N[C@H](CCCCNC(=O)COCCOCCNC(=O)COCCOCCNC(=O)CC[C@@H](NC(=O)CCCCCCCCCCCCCCCCCCC(=O)O)C(=O)O)C(N)=O)CCOCC2)NC1=O] |

TABLE 1M-continued

Compounds.

| SEQ ID | Structure<br>Peptide Sequence<br>Smiles |
|---|---|
| | MeCO-orn(d)-Pen(3)-N-T-7MeW-K(Ac)-Pen(3)-AEF-2Nal-THP-E-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCCCCC(O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 440 | 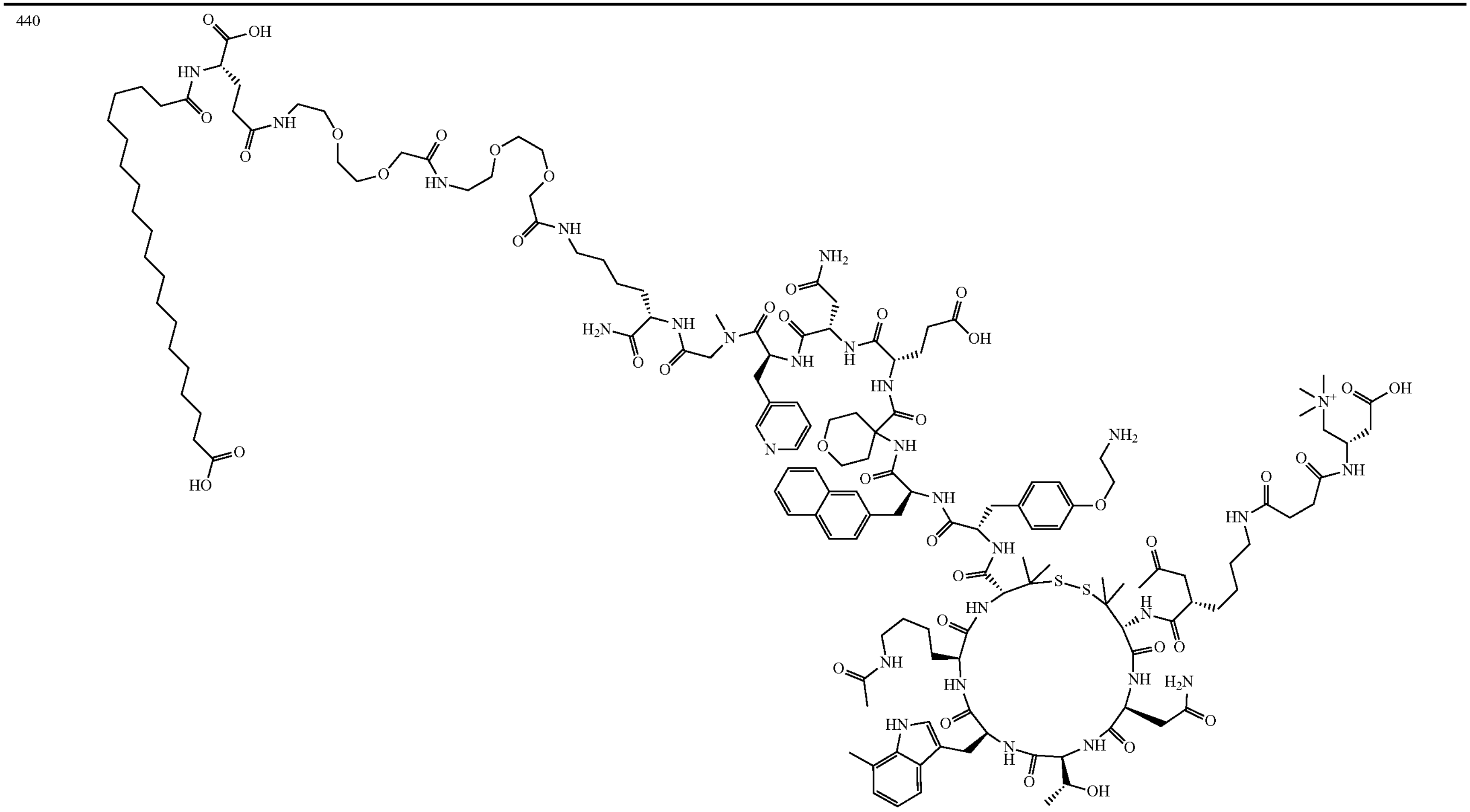 |

TABLE 1M-continued

| Compounds. | |
|---|---|
| SEQ ID | Structure<br>Peptide Sequence<br>Smiles |
| | MeCO-k(D)-Pen(3)N-T-7MeW-K(Ac)-Pen(3)-AEF-2Nal-THP-E-N-3Pya-Sar-K(PEG2PEG2gEC20OH)-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CC(N)=O)=O)NC([C@@H](CCCCNC(CCC(N[C@@H](CC(O)=O)C[N+](C)(C)C)=O)=O)NC(C)=O)=O)C(N[C@@H](Cc(cc2)ccc2OCCN)C(N[C@@H](Cc2cc3ccccc3cc2)C(NC2(CCOCC2)C(N[C@@H](CCC(O)=O)C(N[C@@H](CC(N)=O)C(N[C@@H](Cc2cnccc2)C(N(C)CC(N[C@@H](CCCCNC(COCCOCCNC(COCCOCCNC(CC[C@@H](C(O)=O)NC(CCCCCCCCCCCCCCCCCCC(O)=O)=O)=O)=O)=O)C(N)=O)=O)=O)=O)=O)=O)=O)=O)=O)=O)=O)=O)NC1=O)O |

TABLE 1M-continued
| Compounds. | |
|---|---|
| SEQ ID | Structure<br>Peptide Sequence<br>Smiles |
| 441 | 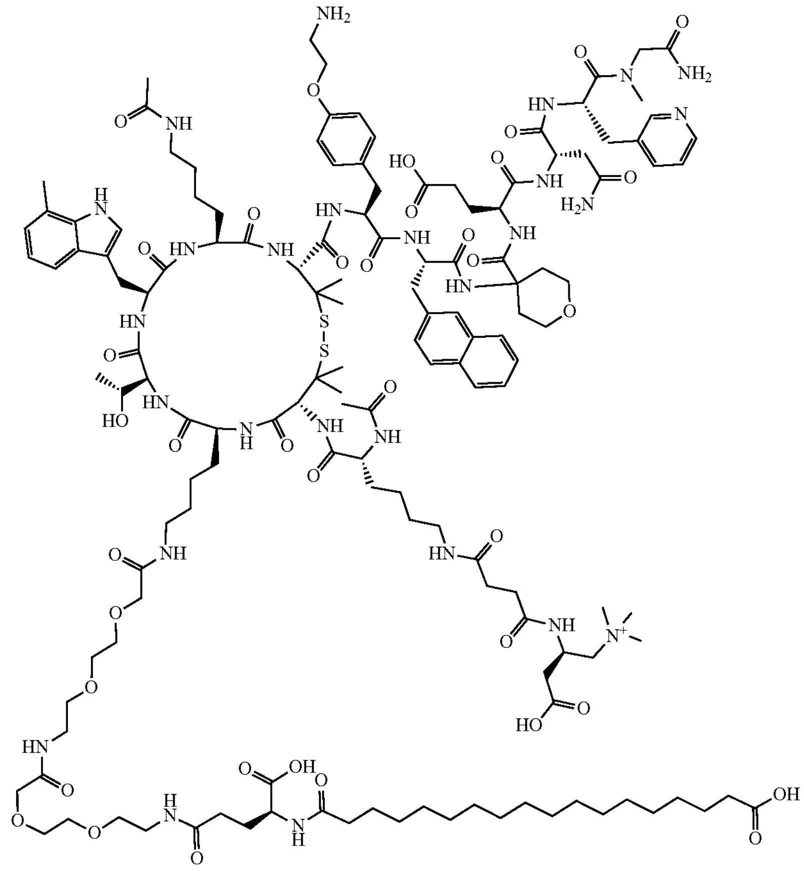 [SMILES: CC(=O)NCCCC[C@@H]1NC(=O)[C@H](Cc2c[nH]c3c(C)cccc23)NC(=O)[C@H]([C@@H](C)O)NC(=O)[C@H](CCCCNC(=O)COCCOCCNC(=O)COCCOCCNC(=O)CC[C@H](NC(=O)CCCCCCCCCCCCCCCCC(=O)O)C(=O)O)NC(=O)[C@@H](NC(=O)[C@@H](CCCCNC(=O)CCC(=O)N[C@H](CC(=O)O)C[N+](C)(C)C)NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>MeCO-k(d)-Pen(3)-K(PEG2PEG2gEC18OH)-T-7MeW-K(Ac)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC(C)=O)C(N[C@@H](C(C)(C)SSC(C)(C)[C@@H](C(N[C@H]1CCCCNC(COCCOCCNC(COCCOCCNC(CC[C@@H](C(O)=O)NC(CCCCCCCCCCCCCCCCC(O)=O)=O)=O)=O)=O)=O)NC([C@@H](CCCCNC(CCC(N[C@H](CC(O)=O)C[N+] |

TABLE 1M-continued

| SEQ ID | Compounds.<br>Structure<br>Peptide Sequence<br>Smiles |
|---|---|
| | (C)(C)C)=O)=O)NC(C)=O)=O)C(N[C@@H](Cc(cc2)ccc2OCCN)C(N[C@@H](Cc2c c3ccccc3cc2)C(NC2(CCOCC2)C(N[C@@H](CCC(O)=O)C(N[C@@H](CC(N)=O) C(N[C@@H](Cc2cnccc2)C(N(C)CC(N)=O)=O)=O)=O)=O)=O)=O)=O)=O)=O)=O) NC1=O)O |
| 442 | 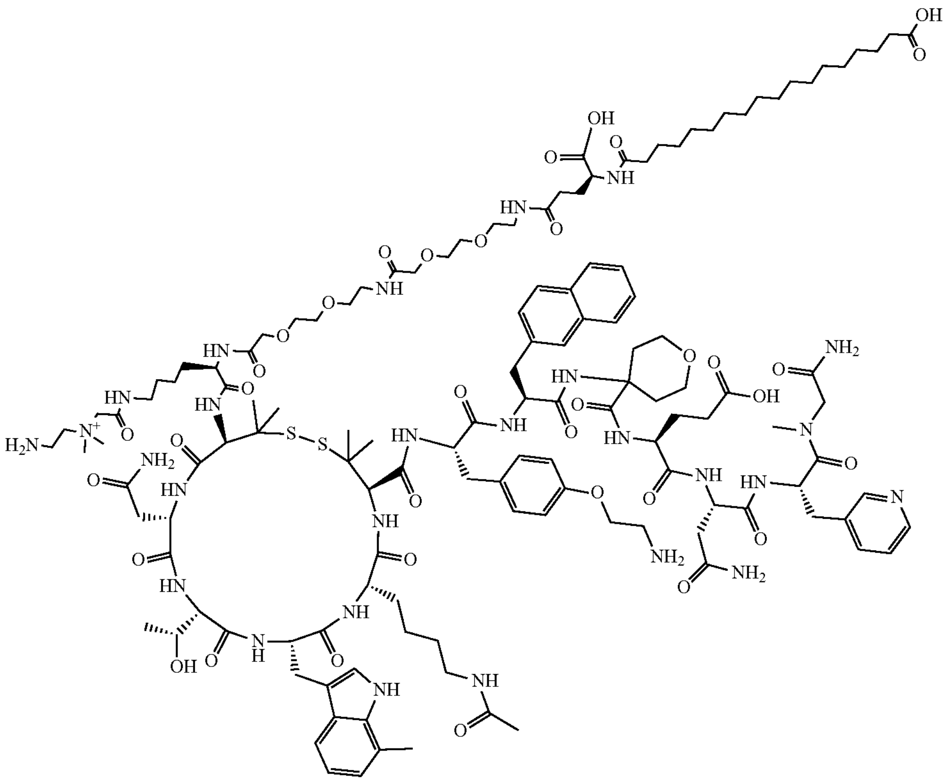 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)C[N+](C)(C)CCN)NC(=O)COCCOCCNC(=O)COCCOCCNC(=O)CC[C@H](NC(=O)CCCCCCCCCCCCCCCCC(=O)O)C(=O)O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>HOC18gEPEG2PEG2CO-k(SP6)-Pen(3)-N-T-7MeW-K(Ac)-Pen(3)-AEF-2Nal-THP-E-N-3Pya-Sar-CONH2<br>C[C@H]([C@@H](C(N[C@@H](Cc1c[nH]c2c1cccc2C)C(N[C@@H](CCCCNC (C)=O)C(N[C@@H](C(C)(C)SSC(C)(C)[C@@H](C(N[C@H]1CC(N)=O)=O)NC ([C@@H](CCCCNC(C[N+](C)(C)CCN)=O)NC(COCCOCCNC(COCCOCCNC(CC |

TABLE 1M-continued

| Compounds. | |
|---|---|
| SEQ ID | Structure<br>Peptide Sequence<br>Smiles |
| | [C@@H](C(O)=O)NC(CCCCCCCCCCCCCCCCCC(O)=O)=O)=O)=O)=O)=O)C(N<br>[C@@H](Cc(cc2)ccc2OCCN)C(N[C@@H](Cc2cc3ccccc3cc2)C(NC2(CCOCC2)C<br>(N[C@@H](CCC(O)=O)C(N[C@@H](CC(N)=O)C(N[C@@H](Cc2cnccc2)C(N(C)<br>CC(N)=O)=O)=O)=O)=O)=O)=O)=O)=O)=O)=O)NC1=O)O |
| 443 | 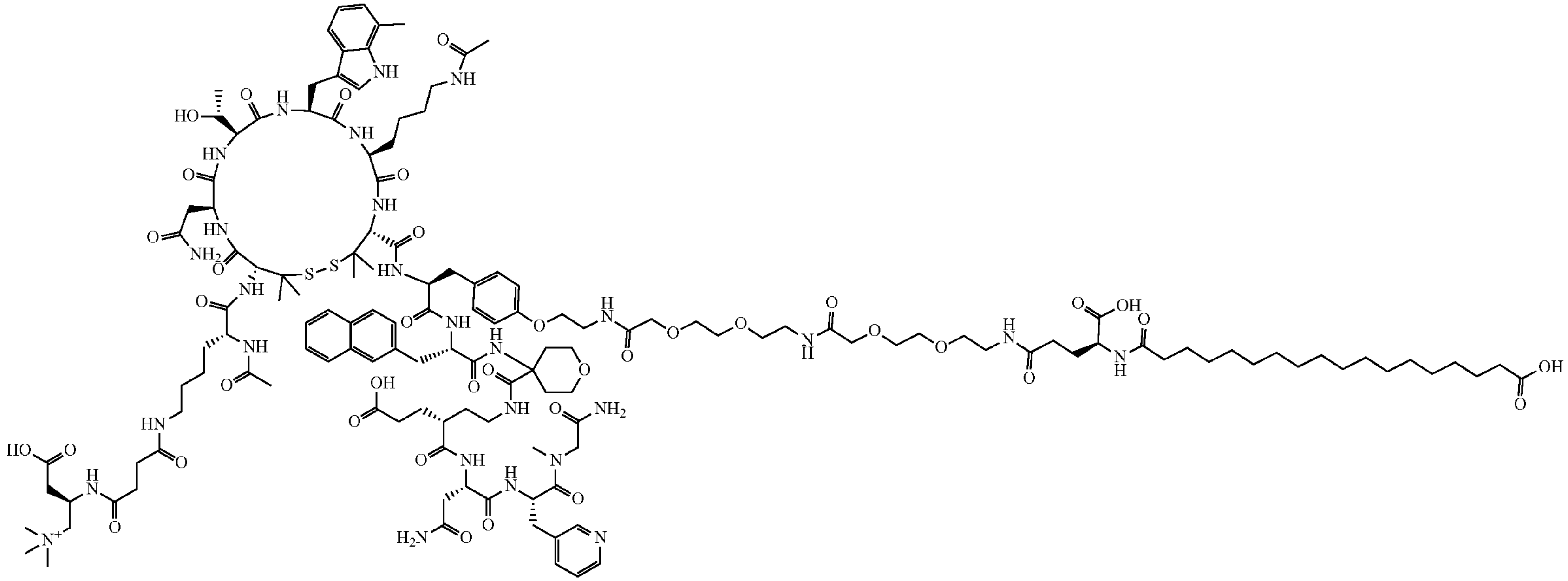 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(=O)[C@@H](CCCCNC(=O)CCC(=O)N[C@H](CC(=O)O)C[N+](C)(C)C)NC(C)=O)C(C)(C)SSC(C)(C)[C@@H](C(=O)N[C@@H](Cc2ccc(OCCNC(=O)COCCOCCNC(=O)COCCOCCNC(=O)CC[C@H](NC(=O)CCCCCCCCCCCCCCCCC(=O)O)C(=O)O)cc2)C(=O)N[C@@H](Cc2ccc3ccccc3c2)C(=O)NC2(C(=O)NCC[C@@H](CCC(=O)O)C(=O)N[C@@H](CC(N)=O)C(=O)N[C@@H](Cc3cccnc3)C(=O)N(C)CC(N)=O)CCOCC2)NC1=O]<br>MeCO-k(d)-Pen(3)-N-T-7MeW-K(Ac)-Pen(3)-AEF(PEG2PEG2gEC18OH)-2Nal-<br>THP-E-N-3Pya-Sar-CONH2<br>C[C@H]([C@@H](C(N[C@@H](Cc1c[nH]c2c1cccc2C)C(N[C@@H](CCCCNC<br>(C)=O)C(N[C@@H](C(C)(C)SSC(C)(C)[C@@H](C(N[C@H]1CC(N)=O)=O)NC<br>([C@@H](CCCCNC(CCC(N[C@H](CC(O)=O)C[N+](C)(C)C)=O)=O)NC(C)=O)=<br>O)C(N[C@@H](Cc(cc2)ccc2OCCNC(COCCOCCNC(COCCOCCNC(CC[C@@H]<br>(C(O)=O)NC(CCCCCCCCCCCCCCCCCC(O)=O)=O)=O)=O)=O)C(N[C@@H](Cc2<br>cc3ccccc3cc2)C(NC2(CCOCC2)C(N[C@@H](CCC(O)=O)C(N[C@@H](CC(N)=<br>O)C(N[C@@H](Cc2cnccc2)C(N(C)CC(N)=O)=O)=O)=O)=O)=O)=O)=O)=O)=O)=<br>O)NC1=O)O |

Synthesis

The compounds described herein may be synthesized by many techniques that are known to those skilled in the art. In certain aspects, monomer subunits are synthesized and purified using the techniques described in the accompanying Examples.

In some aspects, the present invention provides a method of producing a compound (or monomer subunit thereof) of the invention, comprising chemically synthesizing a peptide having an amino acid sequence described herein, including but not limited to any of the amino acid sequences set forth in the compounds of Formula (I) to Formula (X),Table 1A, Table 1B, Table 1C, Table 1D, Table 1E, Table 1F, Table 1G, Table 1H, Table 11, Table 1J, Table 1K, Table 1L, and Table 1M herein. In some aspects, a portion of the peptide is recombinantly synthesized, instead of being chemically synthesized. In some aspects, methods of producing a compound further include cyclizing the compound precursor after the constituent subunits have been attached. In particular aspects, cyclization is accomplished via any of the various methods described herein.

The present invention may include, but is not limited to, polynucleotides and vectors (e.g., expression vectors) that encode a portion of the amino acid sequence of a compound described herein, for instance, in the accompanying Examples, Table 1A, Table 1B, Table 1C, Table 1D, Table 1E, Table 1F, Table 1G, Table 1H, Table 11, Table 1J, Table 1K, or Table 1L.

The present invention further describes synthesis of lipidated compounds described herein, such as the compounds of Formula (I) to Formula (X), and the compounds of Table 1A, Table 1B, Table 1C, Table 1D, Table 1E, Table 1F, Table 1G, Table 1H, Table 11, Table 1J, Table 1K, Table 1L, and Table 1M.

In some aspects, one or more of the amino acid residues or amino acid monomers are lipidated and then covalently attached to one another to form a compound of the invention.

In some aspects, one or more of the amino acid residues or amino acid monomers are covalently attached to one another and lipidated at an intermediate oligomer stage before attaching additional amino acids and cyclization to form a compound of the invention.

In some aspects, a cyclic peptide is synthesized and then lipidated to form a compound of the invention. Illustrative synthetic methods are described in the Examples.

The present invention further describes synthesis of compounds described herein, such as the compounds of Formulas (I) to (X) and the compounds of Table 1A, Table 1B, Table 1C, Table 1D, Table 1E, Table 1F, Table 1G, Table 1H, Table 11, Table 1J, Table 1K, Table 1L, and Table 1M. Illustrative synthetic methods are described in the Examples.

I. Pharmaceutical Compositions

The present invention relates to pharmaceutical composition which comprises an IL-23R inhibitor of the present invention.

The present invention includes pharmaceutical compositions comprising one or more inhibitors of the present invention and a pharmaceutically acceptable carrier, diluent or excipient.

The pharmaceutically acceptable carrier, diluent or excipient may be a solid, semi-solid or liquid filler, diluent, encapsulating material or formulation auxiliary of any type. Prevention of the action of microorganisms may be ensured by the inclusion of various antibacterial and antifungal agents, for example, paraben, chlorobutanol, phenol sorbic acid, and the like. It may also be desirable to include isotonic agents such as sugars, sodium chloride, and the like.

The pharmaceutical compositions may be administered orally, parenterally, intracisternally, intravaginally, intraperitoneally, intrarectally, topically (as by powders, ointments, drops, suppository, or transdermal patch), by inhalation (such as intranasal spray), ocularly (such as intraocularly) or buccally. The term "parenteral" as used herein refers to modes of administration which include intravenous, intramuscular, intraperitoneal, intrasternal, subcutaneous, intradermal and intraarticular injection and infusion. Accordingly, in certain embodiments, the compositions are formulated for delivery by any of these routes of administration. A pharmaceutical composition may be formulated for and administered orally. A pharmaceutical composition may be formulated for and administered parenterally.

In particular aspects, an IL-23R inhibitor of the present invention, is suspended in a sustained-release matrix. A sustained-release matrix, as used herein, is a matrix made of materials, usually polymers, which are degradable by enzymatic or acid-base hydrolysis or by dissolution. Once inserted into the body, the matrix is acted upon by enzymes and body fluids. A sustained-release matrix desirably is chosen from biocompatible materials such as liposomes, polylactides (polylactic acid), polyglycolide (polymer of glycolic acid), polylactide co-glycolide (copolymers of lactic acid and glycolic acid) polyanhydrides, poly(ortho)esters, polypeptides, hyaluronic acid, collagen, chondroitin sulfate, carboxylic acids, fatty acids, phospholipids, polysaccharides, nucleic acids, polyamino acids, amino acids such as phenylalanine, tyrosine, isoleucine, polynucleotides, polyvinyl propylene, polyvinylpyrrolidone and silicone. One embodiment of a biodegradable matrix is a matrix of one of either polylactide, polyglycolide, or polylactide co-glycolide (co-polymers of lactic acid and glycolic acid).

The IL-23R inhibitors of the present invention may be prepared and/or formulated as pharmaceutically acceptable salts or when appropriate in neutral form. Pharmaceutically acceptable salts are non-toxic salts of a neutral form of a compound that possess the desired pharmacological activity of the neutral form. These salts may be derived from inorganic or organic acids or bases. For example, a compound that contains a basic nitrogen may be prepared as a pharmaceutically acceptable salt by contacting the compound with an inorganic or organic acid. Non-limiting examples of pharmaceutically acceptable salts include sulfates, pyrosulfates, bisulfates, sulfites, bisulfites, phosphates, monohydrogen-phosphates, dihydrogenphosphates, metaphosphates, pyrophosphates, chlorides, bromides, iodides, acetates, propionates, decanoates, caprylates, acrylates, formates, isobutyrates, caproates, heptanoates, propiolates, oxalates, malonates, succinates, suberates, sebacates, fumarates, maleates, butyne-1,4-dioates, hexyne-1,6-dioates, benzoates, chlorobenzoates, methylbenzoates, dinitrobenzoates, hydroxybenzoates, methoxybenzoates, phthalates, sulfonates, methylsulfonates, propylsulfonates, besylates, xylenesulfonates, naphthalene-1-sulfonates, naphthalene-2-sulfonates, phenylacetates, phenylpropionates, phenylbutyrates, citrates, lactates, γ-hydroxybutyrates, glycolates, tartrates, and mandelates. Lists of other suitable pharmaceutically acceptable salts are found in Remington: The Science and Practice of Pharmacy, 21st Edition, Lippincott Wiliams and Wilkins, Philadelphia, Pa., 2006.

Examples of "pharmaceutically acceptable salts" of the compounds disclosed herein also include salts derived from an appropriate base, such as an alkali metal (for example, sodium, potassium), an alkaline earth metal (for example, magnesium), ammonium and $NX_4^+$ (wherein X is $C_1$-$C_4$ alkyl). Also included are base addition salts, such as sodium or potassium salts.

The present invention relates to pharmaceutical compositions comprising an IL-23R inhibitor of the present invention or pharmaceutically acceptable salts, isomers, or a mixture thereof, in which from 1 to n hydrogen atoms attached to a carbon atom may be replaced by a deuterium atom or D, in which n is the number of hydrogen atoms in the molecule. As known in the art, the deuterium atom is a non-radioactive isotope of the hydrogen atom. Such compounds may increase resistance to metabolism, and thus may be useful for increasing the half-life of the compounds described herein or pharmaceutically acceptable salts, isomer, or a mixture thereof when administered to a mammal. See, e.g., Foster, "Deuterium Isotope Effects in Studies of Drug Metabolism," Trends Pharmacol. Sci., 5(12):524-527 (1984). Such compounds are synthesized by means well known in the art, for example by employing starting materials in which one or more hydrogen atoms have been replaced by deuterium.

Examples of isotopes that can be incorporated into the disclosed compounds also include isotopes of hydrogen, carbon, nitrogen, oxygen, phosphorous, fluorine, chlorine, and iodine, such as $^{2}H$, $^{3}H$, $^{11}C$, $^{13}C$, $^{14}C$, $^{13}N$, $^{15}N$, $^{15}O$, $^{17}O$, $^{18}O$, $^{31}P$, $^{32}P$, $^{35}S$, $^{18}F$, $^{36}Cl$, $^{123}I$, and $^{125}I$, respectively. Substitution with positron emitting isotopes, such as $^{11}C$, $^{18}F$, $^{15}O$ and $^{13}N$, can be useful in Positron Emission Topography (PET) studies for examining substrate receptor occupancy. Isotopically labeled compounds of Formula (I), can generally be prepared by conventional techniques known to those skilled in the art or by processes analogous to those described in the Examples as set out below using an appropriate isotopically labeled reagent in place of the non-labeled reagent previously employed.

In some aspects, pharmaceutical compositions for parenteral injection comprise pharmaceutically acceptable sterile aqueous or nonaqueous solutions, dispersions, suspensions or emulsions, or sterile powders, for reconstitution into sterile injectable solutions or dispersions just prior to use. Examples of suitable aqueous and nonaqueous carriers, diluents, solvents or vehicles include water, ethanol, polyols (such as glycerol, propylene glycol, polyethylene glycol, and the like), carboxymethylcellulose and suitable mixtures thereof, β-cyclodextrin, vegetable oils (such as olive oil), and injectable organic esters such as ethyl oleate. Proper fluidity may be maintained, for example, by the use of coating materials such as lecithin, by the maintenance of the required particle size in the case of dispersions, and by the use of surfactants. These compositions may also contain adjuvants such as preservative, wetting agents, emulsifying agents, and dispersing agents. Prolonged absorption of an injectable pharmaceutical form may be brought about by the inclusion of agents which delay absorption, such as aluminum monostearate and gelatin.

Injectable depot forms include those made by forming microencapsulated matrices of the peptide inhibitor in one or more biodegradable polymers such as polylactide-polyglycolide, poly(orthoesters), poly(anhydrides), and (poly)glycols, such as PEG. Depending upon the ratio of peptide to polymer and the nature of the particular polymer employed, the rate of release of the peptide inhibitor can be controlled. Depot injectable Formulations are also prepared by entrapping the peptide inhibitor in liposomes or microemulsions compatible with body tissues.

The injectable formulations may be sterilized, for example, by filtration through a bacterial-retaining filter, or by incorporating sterilizing agents in the form of sterile solid compositions which can be dissolved or dispersed in sterile water or other sterile injectable medium just prior to use.

Topical administration includes administration to the skin or mucosa, including surfaces of the lung and eye. Compositions for topical lung administration, including those for inhalation and intranasal, may involve solutions and suspensions in aqueous and non-aqueous Formulations and can be prepared as a dry powder which may be pressurized or non-pressurized. In non-pressurized powder compositions, the active ingredient may be finely divided form may be used in admixture with a larger sized pharmaceutically acceptable inert carrier comprising particles having a size, for example, of up to 100 micrometers in diameter. Suitable inert carriers include sugars such as lactose.

Alternatively, a pharmaceutical composition of the present invention may be pressurized and contain a compressed gas, such as nitrogen or a liquefied gas propellant. The liquefied propellant medium and indeed the total composition may be such that the active ingredient does not dissolve therein to any substantial extent. The pressurized composition may also contain a surface-active agent, such as a liquid or solid non-ionic surface-active agent or may be a solid anionic surface-active agent. It is preferred to use the solid anionic surface-active agent in the form of a sodium salt.

A further form of topical administration is to the eye. A peptide inhibitor of the present disclosure may be delivered in a pharmaceutically acceptable ophthalmic vehicle, such that the peptide inhibitor is maintained in contact with the ocular surface for a sufficient time period to allow the peptide inhibitor to penetrate the corneal and internal regions of the eye, as for example the anterior chamber, posterior chamber, vitreous body, aqueous humor, vitreous humor, cornea, iris/ciliary, lens, choroid/retina and sclera. The pharmaceutically acceptable ophthalmic vehicle may, for example, be an ointment, vegetable oil or an encapsulating material. Alternatively, the peptide inhibitors of the invention may be injected directly into the vitreous and aqueous humor.

Compositions for rectal or vaginal administration include suppositories which may be prepared by mixing the peptide inhibitors of this invention with suitable non-irritating excipients or carriers such as cocoa butter, polyethylene glycol or a suppository wax, which are solid at room temperature but liquid at body temperature and, therefore, melt in the rectum or vaginal cavity and release the active compound.

Peptide inhibitors of the present invention may also be administered in liposomes or other lipid-based carriers. As is known in the art, liposomes are generally derived from phospholipids or other lipid substances. Liposomes are formed by mono- or multi-lamellar hydrated liquid crystals that are dispersed in an aqueous medium. Any non-toxic, physiologically acceptable and metabolizable lipid capable of forming liposomes can be used. The present compositions in liposome form can contain, in addition to a peptide inhibitor of the present invention, stabilizers, preservatives, excipients, and the like. In certain embodiments, the lipids comprise phospholipids, including the phosphatidyl cholines (lecithins) and serines, both natural and synthetic. Methods to form liposomes are known in the art.

Pharmaceutical compositions suitable for parenteral administration in a method or use described herein may comprise sterile aqueous solutions and/or suspensions of the IL:-23R inhibitors made isotonic with the blood of the recipient, generally using sodium chloride, glycerin, glucose, mannitol, sorbitol, and the like.

The present invention provides a pharmaceutical composition for oral delivery. Compositions and peptide inhibitors of the present invention may be prepared for oral administration according to any of the methods, techniques, and/or delivery vehicles described herein. Further, one having skill in the art will appreciate that the peptide inhibitors of the instant invention may be modified or integrated into a system or delivery vehicle that is not disclosed herein yet is well known in the art and compatible for use in oral delivery of peptides.

Formulations for oral administration may comprise adjuvants (e.g., resorcinols and/or nonionic surfactants such as polyoxyethylene oleyl ether and n-hexadecylpolyethylene ether) to artificially increase the permeability of the intestinal walls, and/or enzymatic inhibitors (e.g., pancreatic trypsin inhibitors, diisopropylfluorophosphate (DFF) or trasylol) to inhibit enzymatic degradation. In certain embodiments, the peptide inhibitor of a solid-type dosage form for oral administration can be mixed with at least one additive, such as sucrose, lactose, cellulose, mannitol, trehalose, raffinose, maltitol, dextran, starches, agar, alginates, chitins, chitosans, pectins, gum tragacanth, gum arabic, gelatin, collagen, casein, albumin, synthetic or semisynthetic polymer, or glyceride. These formulations for oral administration can also contain other type(s) of additives, e.g., inactive diluting agent, lubricant such as magnesium stearate, paraben, preserving agent such as sorbic acid, ascorbic acid, alpha-tocopherol, antioxidants such as cysteine, disintegrators, binders, thickeners, buffering agents, pH adjusting agents, sweetening agents, flavoring agents or perfuming agents.

In particular aspects, oral dosage forms or unit doses compatible for use with the peptide inhibitors of the present invention may include a mixture of peptide inhibitor and nondrug components or excipients, as well as other non-reusable materials that may be considered either as an ingredient or packaging. Oral compositions may include at least one of a liquid, a solid, and a semi-solid dosage forms. In some embodiments, an oral dosage form is provided comprising an effective amount of peptide inhibitor, wherein the dosage form comprises at least one of a pill, a tablet, a capsule, a gel, a paste, a drink, a syrup, ointment, and suppository. In some instances, an oral dosage form is provided that is designed and configured to achieve delayed release of the peptide inhibitor in the subject's small intestine and/or colon.

Tablets may contain excipients, glidants, fillers, binders and the like. Aqueous compositions are prepared in sterile form, and when intended for delivery by other than oral administration generally will be isotonic. Compositions may optionally contain excipients such as those set forth in the "Handbook of Pharmaceutical Excipients" (1986). Excipients include ascorbic acid and other antioxidants, chelating agents such as EDTA, carbohydrates such as dextran, hydroxyalkylcellulose, hydroxyalkylmethylcellulose, stearic acid and the like. The pH of the compositions ranges from, for example, about 3 to about 11. The pH of the compositions may, for example, range from about 5 to about 7 or from about 7 to about 10.

An oral pharmaceutical composition of the present invention may comprise an IL-23R inhibitor of the present invention may comprise an enteric coating that is designed to delay release of the IL-23R inhibitor in the small intestine. The present invention relates to a pharmaceutical composition that comprises an IL-23R inhibitor of the present invention and a protease inhibitor, such as aprotinin, in a delayed release pharmaceutical formulation. Pharmaceutical compositions (e.g., oral pharmaceutical compositions) may comprise an enteric coat that is soluble in gastric juice at a pH of about 5.0 or higher. Such enteric coatings may comprise a polymer having dissociable carboxylic groups, such as derivatives of cellulose, including hydroxypropylmethyl cellulose phthalate, cellulose acetate phthalate and cellulose acetate trimellitate and similar derivatives of cellulose and other carbohydrate polymers.

An oral pharmaceutical composition comprising an IL-23R inhibitor of the present invention that comprises an IL-23R inhibitor which may comprise an enteric coating that is designed to protect and release the pharmaceutical composition in a controlled manner within the subject's lower gastrointestinal system, and to avoid systemic side effects. In addition to enteric coatings, the peptide inhibitors of the instant invention may be encapsulated, coated, engaged or otherwise associated within any compatible oral drug delivery system or component. For example, in some embodiments an IL-23R inhibitor of the present invention is provided in a lipid carrier system comprising at least one of polymeric hydrogels, nanoparticles, microspheres, micelles, and other lipid systems.

To overcome peptide degradation of an IL-23R inhibitor of the present invention in the small intestine, the pharmaceutical compositions may comprise a hydrogel polymer carrier system in which a peptide inhibitor of the present invention is contained, whereby the hydrogel polymer protects the IL-23R inhibitor from proteolysis in the small intestine and/or colon. An IL-23R inhibitor may further be formulated for compatible use with a carrier system that is designed to increase the dissolution kinetics and enhance intestinal absorption of the peptide. These methods include the use of liposomes, micelles and nanoparticles to increase GI tract permeation of peptides.

Various bioresponsive systems may also be combined with one or more an IL-23R inhibitors of the present invention to provide a pharmaceutical agent for oral delivery. For example, an IL-23R inhibitor of the present invention may be used in combination with a bioresponsive system, such as hydrogels and mucoadhesive polymers with hydrogen bonding groups (e.g., PEG, poly(methacrylic) acid [PMAA], cellulose, Eudragit®, chitosan and alginate) to provide a therapeutic agent for oral administration.

In certain aspects, pharmaceutical composition and formulations may include an IL-23R inhibitor of the present invention and one or more absorption enhancers, enzyme inhibitors, or mucoso adhesive polymers. In an embodiment, the absorption enhancer may be an intestinal permeation enhancer.

IL-23R inhibitors of the present invention may be formulated in a formulation vehicle, such as, e.g., emulsions, liposomes, microsphere or nanoparticles.

The present invention provides for a method for treating a subject with an IL-23R inhibitor of the present invention having an increased half-life. In one aspect, the present invention provides a peptide inhibitor having a half-life of at least several hours to one day in vitro or in vivo (e.g., when administered to a human subject) sufficient for daily (q.d.) or twice daily (b.i.d.) dosing of a therapeutically effective amount. In certain embodiments, the IL-23R inhibitor has a half-life of three days or longer sufficient for weekly (q.w.) dosing of a therapeutically effective amount. In certain embodiments, the IL-23R inhibitor has a half-life of eight days or longer sufficient for bi-weekly (b.i.w.) or monthly dosing of a therapeutically effective amount. In certain embodiments, the IL-23R inhibitor is derivatized or modified such that is has a longer half-life as compared to the underivatized or unmodified peptide inhibitor. In certain embodiments, the IL-23R inhibitor contains one or more chemical modifications to increase serum half-life.

When used in at least one of the treatments or delivery systems described herein, a peptide inhibitor of the present invention may be employed in pure form or, where such forms exist, in pharmaceutically acceptable salt form.

The total daily usage of the IL-23R inhibitor and compositions of the present invention can be decided by the attending physician within the scope of sound medical judgment. The specific therapeutically effective dose level for any particular subject will depend upon a variety of factors including: a) the disorder being treated and the severity of the disorder; b) activity of the specific compound employed; c) the specific composition employed, the age, body weight, general health, sex and diet of the patient; d) the time of administration, route of administration, and rate of excretion of the specific peptide inhibitor employed; e) the duration of the treatment; f) drugs used in combination or coincidental with the specific peptide inhibitor employed, and like factors well known in the medical arts.

In particular embodiments, the total daily dose of an IL-23R inhibitor of the present invention to be administered to a human or other mammal host in single or divided doses may be in amounts, for example, from 0.0001 to 300 mg/kg body weight daily or 1 to 300 mg/kg body weight daily.

The compositions may conveniently be presented in unit dosage form and can be prepared by any of the methods well known in the art of pharmacy. Techniques and compositions generally are found in Remington's Pharmaceutical Sciences (Mack Publishing Co., Easton, PA). Such methods include the step of bringing into association the active ingredient with the carrier which constitutes one or more accessory ingredients. In general, the compositions are prepared by uniformly and intimately bringing into association the active ingredient with liquid carriers or finely divided solid carriers or both, and then, if necessary, shaping the product.

Compositions suitable for oral administration can be presented as discrete units such as capsules, cachets or tablets each containing a predetermined amount of the active ingredient; as a powder or granules; as a solution or a suspension in an aqueous or non-aqueous liquid; or as an oil-in-water liquid emulsion or a water-in-oil liquid emulsion. The active ingredient may also be administered as a bolus, electuary or paste. The active ingredient may also be administered as a buccal or sublingual formulation. Buccal or sublingal formulations may comprise an active ingredient in a matrix that releases the active ingredient for transport across the buccal and/or sublingual membranes. The buccal or sublingual formulation may further include a rate controlling matrix that releases the active compounds at a a predetermined rate for transport across the buccal and/or sublingual membranes. The buccal or sublingual formulation may further include one or more compounds selected from the group consisting of (i) taste masking agents, (ii) enhancers, (iii) complexing agents, and mixtures thereof; and (iv) other pharmaceutically acceptable carriers and/or excipients. The enhancer may be a permeation enhancer.

A tablet is made by compression or molding, optionally with one or more accessory ingredients. Compressed tablets can be prepared by compressing in a suitable machine the active ingredient in a free-flowing form such as a powder or granules, optionally mixed with a binder, lubricant, inert diluent, preservative, surface active or dispersing agent. Molded tablets may be made by molding in a suitable machine a mixture of the powdered active ingredient moistened with an inert liquid diluent. The tablets can optionally be coated or scored and optionally are formulated so as to provide slow or controlled release of the active ingredient therefrom.

II. Non-Invasive Detection of Intestinal Inflammation

The IL-23R inhibitors of the present invention may be used for detection, assessment and diagnosis of intestinal inflammation by microPET imaging, wherein the peptide inhibitor is labeled with a chelating group or a detectable label, as part of a non-invasive diagnostic procedure. In certain embodiments, an IL-23R inhibitor of the present invention is conjugated with a bifunctional chelator. In certain embodiments, an IL-23R inhibitor of the present invention is radiolabeled. The labeled an IL-23R inhibitor is then administered to a subject orally or rectally. In certain embodiments, an IL-23R inhibitor is included in drinking water. Following uptake of an IL-23R inhibitor, microPET imaging may be used to visualize inflammation throughout the subject's bowels and digestive track.

III. Methods of Treatments and/or Uses

The present invention relates to relates to methods for treating a subject afflicted with a condition or indication associated with IL-23 or IL-23R (e.g., activation of the IL-23/IL-23R signaling pathway), where the method comprises administering to the subject an IL-23R inhibitor disclosed herein. In one aspect, the present invention relates to a method for treating a subject afflicted with a condition or indication characterized by inappropriate, deregulated, or increased IL-23 or IL-23R activity or signaling, comprising administering to the individual a peptide inhibitor of the present invention in an amount sufficient to inhibit (partially or fully) binding of IL-23 to an IL-23R in the subject. The inhibition of IL-23 binding to IL-23R may occur in particular organs or tissues of the subject, e.g., the stomach, small intestine, large intestine/colon, intestinal mucosa, lamina propria, Peyer's Patches, mesenteric lymph nodes, or lymphatic ducts.

The present invention relates to methods comprising providing a peptide inhibitor described herein to a subject in need thereof. The subject in need thereof may be a subject that has been diagnosed with or has been determined to be at risk of developing a disease or disorder associated with IL-23/IL-23R. The subject may be a mammal. The subject may be, in particular, a human.

The disease or disorder to be treated by treatment with an IL-23R inhibitor of the present invention may be autoimmune inflammation and related diseases and disorders, such as multiple sclerosis, asthma, rheumatoid arthritis, inflammation of the gut, inflammatory bowel diseases (IBDs), juvenile IBD, adolescent IBD, Crohn's disease, ulcerative colitis, sarcoidosis, Systemic Lupus Erythematosus, ankylosing spondylitis (axial spondyloarthritis), psoriatic arthritis, or psoriasis. In particular, the disease or disorder may be psoriasis (e.g., plaque psoriasis, guttate psoriasis, inverse psoriasis, pustular psoriasis, Palmo-Plantar Pustulosis, psoriasis vulgaris, or erythrodermic psoriasis), atopic dermatitis, acne ectopica, ulcerative colitis, Crohn's disease, Celiac disease (nontropical Sprue), enteropathy associated with seronegative arthropathies, microscopic colitis, collagenous colitis, eosinophilic gastroenteritis/esophagitis, colitis associated with radio- or chemo-therapy, colitis associated with disorders of innate immunity as in leukocyte adhesion deficiency-1, chronic granulomatous disease, glycogen storage disease type 1b, Hermansky-Pudlak syndrome, Chediak-Higashi syndrome, Wiskott-Aldrich Syndrome, pouchitis, pouchitis resulting after proctocolectomy and ileoanal anastomosis, gastrointestinal cancer, pancreatitis, insulin-dependent diabetes mellitus, mastitis, cholecystitis, cholangitis, primary biliary cirrhosis, viral-associated enteropathy, pericholangitis, chronic bronchitis, chronic sinusitis, asthma, uveitis, or graft versus host disease.

The present invention relates to a method or use of an IL-23R inhibitor for treating an inflammatory disease in a subject that includes administering to the subject a therapeutically effective amount of an IL-23R inhibitor of the present invention or pharmaceutically acceptable solvate or salt thereof, or a composition disclosed herein comprising an IL-23 inhibitor of the present invention. In some aspects, the present invention provides a method of treating an inflammatory disease in a subject that includes administering to the subject a therapeutically effective amount of an IL-23R inhibitor of the present invention or pharmaceutically acceptable solvate or salt thereof, or a composition of the present invention. Suitable inflammatory diseases for treatment with a compound or pharmaceutically acceptable salt thereof, or a composition of the present invention, may include, but are not limited to inflammatory bowel disease (IBD), Crohn's disease (CD), ulcerative colitis (UC), psoriasis (PsO), or psoriatic arthritis (PsA) and the like. The inflammatory disease to be treated may be inflammatory bowel disease (IBD), Crohn's disease, or ulcerative colitis. The inflammatory disease to be treated may be selected from psoriasis, or psoriatic arthritis. The inflammatory disease to be treated may be psoriasis The inflammatory disease to be treated may be psoriatic arthritis. The inflammatory disease to be treated may be IBD.

The present invention relates to methods for treating an inflammatory disease in a subject in need thereof, comprising administering to the subject an IL-23R inhibitor disclosed herein (e.g., a peptide inhibitor or the IL-23R of Formula (I) to Formula (X) or any of Tables 1A to 1M. The inflammatory disease may be IBD, Crohn's disease, or ulcerative colitis. In aspect, the IBD may be ulcerative colitis. In an aspect, the IBD may be Crohn's disease. In an aspect, the inflammatory disease may be psoriasis (PsO), or psoriatic arthritis (PsA).

The present invention relates to methods for treating an inflammatory disease in a subject in need thereof, comprising administering to the subject an IL-23R inhibitor of Formula (I). The inflammatory disease may be IBD, Crohn's disease, or ulcerative colitis. In aspect, the IBD may be ulcerative colitis. In an aspect, the IBD may be Crohn's disease. In an aspect, the inflammatory disease may be psoriasis (PsO), or psoriatic arthritis (PsA).

The present invention relates to methods for treating an inflammatory disease in a subject in need thereof, comprising administering to the subject an IL-23R inhibitor of Formula (X). The inflammatory disease may be IBD, Crohn's disease, or ulcerative colitis. In aspect, the IBD may be ulcerative colitis. In an aspect, the IBD may be Crohn's disease. In an aspect, the inflammatory disease may be psoriasis (PsO), or psoriatic arthritis (PsA).

The present invention relates tomethods for treating an inflammatory bowel disease (IBD) in a subject in need thereof, comprising administering to the subject an IL-23R inhibitor of: Example 2 (Compound 2, SEQ ID NO:2); Example (SEQ ID NO:4); Example 11 (SEQ ID NO:11); Example 17 (SEQ ID NO:17); Example 18 (SEQ ID NO:18); Example 19 (SEQ ID NO:19); Example 20 SEQ ID NO:20); Example 21 SEQ ID NO:21); Example 23 (SEQ ID NO:23); or Example 24 (SEQ ID NO:24). The inflammatory disease may be IBD, Crohn's disease, or ulcerative colitis. The IBD may be ulcerative colitis. The IBD may be Crohn's disease. The inflammatory disease may be psoriasis (PsO), or psoriatic arthritis (PsA).

The present invention relates to methods of inhibiting IL-23 binding to an IL-23R on a cell, comprising contacting the IL-23R with a peptide inhibitor of the receptor disclosed herein. The cell may be a mammalian cell. The method may be performed in vitro or in vivo. Inhibition of binding may be determined by a variety of routine experimental methods and assays known in the art.

The present invention relates to a method of selectively inhibiting IL-23 or IL-23R signaling (or the binding of IL-23 to IL-23R) in a subject (e.g., in a subject in need thereof), comprising providing to the subject a peptide inhibitor of the IL-23R described herein. The present invention includes and provides a method of selectively inhibiting IL-23 or IL-23R signaling (or the binding of IL-23 to IL-23R) in the GI tract of a subject (e.g., a subject in need thereof), comprising providing to the subject a peptide inhibitor of the IL-23R of the present invention by oral administration. The exposure of GI tissues (e.g., small intestine or colon) to the administered peptide inhibitor may be at least 10-fold, at least 20-fold, at least 50-fold, or at least 100-fold greater than the exposure (level) in the blood. In particular embodiments, the present invention includes a method of selectively inhibiting IL23 or IL23R signaling (or the binding of IL23 to IL23R) in the GI tract of a subject (e.g., a subject in need thereof), comprising providing to the subject a peptide inhibitor, wherein the peptide inhibitor does not block the interaction between IL-6 and IL-6R or antagonize the IL-12 signaling pathway. In a further related embodiment, the present invention includes a method of inhibiting GI inflammation and/or neutrophil infiltration to the GI, comprising providing to a subject in need thereof a peptide inhibitor of the present invention. In some embodiments, methods of the present invention comprise providing a peptide inhibitor of the present invention (i.e., a first therapeutic agent) to a subject (e.g., a subject in need thereof) in combination with a second therapeutic agent. In certain embodiments, the second therapeutic agent is provided to the subject before and/or simultaneously with and/or after the peptide inhibitor is administered to the subject. In particular embodiments, the second therapeutic agent is an anti-inflammatory agent. In certain embodiments, the second therapeutic agent is a non-steroidal anti-inflammatory drug, steroid, or immune modulating agent. In certain embodiments, the method comprises administering to the subject a third therapeutic agent. In certain embodiments, the second therapeutic agent is an antibody that binds IL-23 or IL-23R.

The present invention relates tomethods of inhibiting IL-23 signaling by a cell, comprising contacting the IL-23R with a peptide inhibitor described herein. In certain embodiments, the cell is a mammalian cell. In particular embodiments, the method is performed in vitro or in vivo. In particular embodiments, the inhibition of IL-23 signaling may be determined by measuring changes in phospho-STAT3 levels in the cell.

In any of the foregoing methods, IL-23R inhibitor administration to a subject may be conducted orally, but other routes of administration are not excluded. Other routes of administration include, but are not limited to, parenteral, subcutaneous, intravenous, intramuscular, intraperitoneal, transdermal, topical, buccal or ocular routes. Dosages of a peptide inhibitor or the IL-23R described herein (e.g., a compound of Formula (I) to Formula (X) or any of Tables 1A to 1M), or salt or solvate thereof to be administered to a subject may be determined by a person of skill in the art taking into account the the disease or condition being treated including its severity, and factors including the age weight, sex, and the like. Exemplary dose ranges include, but are not limited to, from about 1 mg to about 1000 mg, or from about 1 mg to about 500 mg, from about 1 mg to about 100 mg, from about 10 mg to about 50 mg, from about 20 mg to about 40 mg, or from about 20 mg to about 30 mg. A dose range of a peptide inhibitor or the IL-23R described herein may be from about 600 mg to about 1000 mg. A dose range of a peptide inhibitor or the IL-23R described herein may be from about 300 mg to about 600 mg. A dose range of a peptide inhibitor or the IL-23R described herein may be from about 5 mg to about 300 mg. A dose range of a peptide inhibitor or the IL-23R described herein may be from about 25 mg to about 150 mg. A dose range of a peptide inhibitor or the IL-23R described herein may be from about 25 mg to about 100 mg. A dose range of a peptide inhibitor or the IL-23R described herein may be present in a dose range of from about 1 mg to about 100 mg. A dose range of a peptide inhibitor or the IL-23R described herein may be present in a dose range of from about 20 mg to about 40 mg. A dose range of a peptide inhibitor or the IL-23R described herein may be present in a dose range of from about 20 mg to about 30 mg.

IV. Certain Aspects

The following aspects illustrate the invention. These aspects are not intended to limit the scope of the present invention, but rather to provide guidance to the skilled artisan to prepare and use the compounds, compositions, and methods of the present invention. While particular aspects of the present invention are described, the skilled artisan will appreciate that various changes and modifications can be made without departing from the spirit and scope of the invention.

Formula I

1. An interleukin-23 receptor inhibitor which comprises an amino acid sequence of Formula I

R1—X3—X4—X5—T—X7—X8—X9—X10—X11—THP—X13—N—X15—X16—R2 (I)

wherein:

R1 is hydrogen, $C_1$ to $C_4$ alkyl C(O)—, or $C_1$ to $C_4$ alkyl C(O)— substituted with Cl, F, or cyano, or cPEG3aCO;

X3 is dR, R, K, dK, or absent;

X4 is Pen, Abu, aMeC, or C;

X5 is K—Z or dK-Z;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is KAc, dK(Ac), K or dK;

X9 is Pen, Abu, aMeC,or C;

X10 is AEF or dAEF;

X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X13 is K(Ac), d(KAc), E, or dE;

X15 is absent, 3pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P, or dP;

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and Z is group comprising a lipid moiety; and wherein the IL-23R inhibitor is cyclized by a disulfide or thioether first bond between X4 and X9.

2. The IL-23R inhibitor of aspect 1, wherein

X7 is 7MeW or W;

X1I is 2Nal.

X15 is 3Pya; and

X16 is meGly or dmeGly.

3. The IL-23R inhibitor of aspect 1 or aspect 2, wherein. X4 is Pen; and X5 is Pen.

4. The IL-23R inhibitor of aspect of any of aspects 1-3, wherein X5 is dK(gEC16), k(gEC18), dK(PEG2PEG2gEC100H), dK(PEG2PEG2-gEC160H), dK(PEG2PEG2-gEC180H), dK(PEG2PEG2-gEC200H), dK(1PEG2_1PEG2_IsoGlu_C16_Diacid), K(1PEG2_1PEG2_IsoGlu_C18_Diacid), K(gEC16), K(gEC18), K(gEC180H), K(PEG2gE C180H), K(PEG2PEG2-C180H), K(PEG2PEG2gEC180H), K(PEG2-PEG2gE-C180H), K(PEG2PEG2gEC200H), K(PEG2PEG2pgEC180H), K(PEG2PEG2PgEC180H), K(PEG2PEG2-pppgE-C180H), K(PEG2PEG2-PPPgE-C180H), K(PEG2PEG6 gE C180H), or K(PEG6gEC180H.

Formula II

5. An interleukin-23 receptor inhibitor which comprises an amino acid sequence of Formula II

R1—X3—X4—X5—T—X7—X8—X9—X10—X11—X12—X13—X14—X15—X16—X17—R2 (II)

wherein:

R1 is hydrogen, $C_1$ to $C_4$ alkyl C(O)—, or $C_1$ to $C_4$ alkyl C(O)— substituted with Cl, F, or cyano, 5Ava, AEEP, cPEG3aCO, C12gEPEG2PEG2CO, C14gEPEG2PEG2CO or Z;

X3 is dR, dK, dK(d), or absent;

X4 is Pen, Abu, aMeC, or C;

X5 is L, N, aMeN, dK, dK(d), E, or K;

X7 is 7MeW, W, 3Pya, 7(2C1Ph)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is K dK, K-Z, or dK-Z;

X9 is Pen, C, aMeC, Abu;

X10 is AEF, F, or F40Me;

X11 is 2-Nal, Phe(2-Me), Phe(3-Me), Phe(4-Me), Phe (3,4-dimethoxy), 2Quin, 3Quin, 1-Nal, unsubstituted Trp, or Trp substituted with cyano, halo, alkyl, haloalkyl, hydroxy, or alkoxy;

X12 is THP or aMeL;

X13 is E, L, KAc, dK, K, dL, dKAc, or dE;

X14 is N, L, dN, or dL;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, 1MeH or NH(2-(pyridine-3-yl)ethyl);

X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P,or dP, or absent;

X17 is absent or (PEG2PEG2PEG2PEG2gEC12), K(PEG2PEG2gEC12); and

R2 is —OH —NH2, —NH($C_1$ to $C_4$ alkyl), —H($C_1$-$C_4$ alkyl), —N($C_1$ to $C_4$ alkyl)2, each alkyl optionally substituted with Cl, F, or cyano or K(PEG2PEG2gEC12); and Z is group comprising a lipid moiety; and wherein the IL-23R inhibitor is cyclized by a disulfide or thioether first bond between X4 and X9, and an amide second bond when X5 is E and X10 is AEF.

6. The IL-23R inhibitor of aspect 5, wherein:

X3 is absent;

X4 is Pen, Abu, aMeC, or C;

X5 is L, N, aMeN, dK, dK(d), E, or K;

X7 is W or 7MeW;

X8 is K dK, K-Z, or dK-Z;

X9 is Pen, C, aMeC, Abu;

X10 is AEF, F, or F40Me;

X1I is 2Nal;

X12 is THP or aMeL;

X13 is E, L, KAc, dK, or K;

X14 is N, L, dN, or dL;

X15 is 3Pya or NH(2-(pyridin-3-yl)ethyl);

X16 is Sarc or absent;

X17 is absent or K(PEG2PEG2gEC12).

7. The IL-23R inhibitor of aspect 5 or 6, wherein:

X4 is Pen, aMeC, or C;

X9 is Pen, C, or aMeC; and the IL-23R inhibitor is cyclized by a disulfide or thioether first bond between X4 and X9.

8. The IL-23R inhibitor of aspect 5, wherein X8 is K(PEG12_C18_Diacid, K(PEG4_C18_Diacid, K(IsoGlu_C18_Diacid, K(IsoGlu_Palm), K(PEG4_IsoGlu_Palm), K(PEG4_IsoGlu_C18_Diacid, K(PEG12_IsoGlu_Palm), K(PEG12_IsoGlu_C18_Diacid, K(PEG12_OMe), K(PEG2PEG2gEC180H), K(PEG2PEG2gEC200H), K(PEG2PEG2gEC12), K(PEG2PEG2gEC14), or K(C14), K(gEC14).

9. The IL-23R inhibitor of any of aspects 5-8, further comprising a second bond between 5Ava or AEEP at R1 and E at position X13.

Formula III

10. An interleukin-23 receptor inhibitor which comprises an amino acid sequence of Formula III

R1—X3—X4—X5—T—X7—X8—X9—X10—X11—THP—X13—X14—X15—X16—R2 (III)

wherein:

R1 is hydrogen, $C_1$ to $C_4$ alkyl C(O)—, or $C_1$ to $C_4$ alkyl C(O)— substituted with Cl, F, or cyano, or X3 is dR or absent;

X4 is Pen, Abu, aMeC, C;

X5 is N or dN;

X7 is 7MeW, W, 3Pya, 7(2ClPh)W, 7(3(1NMepip) pyraz)W, 7(3(6AzaInd1Me))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7 (124TAZP))W, 7(7Imzpy)W, 7BrW, 7EtW, 7PhW, 7PyrW, A, DT, or D7MeW;

X8 is KAc;

X9 is Pen, Abu, aMeC, C;

X10 is F—Z or AEF-Z;

X11 is 2-Nal, Phe(2-Me), Phe(3-Me), Phe(4-Me), Phe (3,4-dimethoxy), 2Quin, 3Quin, 1-Nal, unsubstituted Trp, or Trp substituted with cyano, halo, alkyl, haloalkyl, hydroxy, or alkoxy;

X13 is K(Ac) dK(Ac). dE, or E;

X14 is L or N;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P,or dP; and Z is group comprising a lipid moiety; and R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and wherein the IL-23R inhibitor is cyclized by a disulfide or thioether first bond between X4 and X9.

11. The IL-23R inhibitor of aspect 10, wherein:

X7 is 7MeW or W;

X11 is 2Nal;

X15 is 3Pya; and

X16 is Sarc or NmeKdCar (N-methyl D-carnitine).

12. The IL-23R inhibitor of aspect 10 or 11, wherein:

X4 is Pen, aMeC, or C; and

X9 is Pen, C, or aMeC;and the IL-23R inhibitor is cyclized by a disulfide or thioether first bond between X4 and X9.

13. The IL-23R inhibitor of any of aspects 10-12, wherein X10 (PEG2PEG2gEC180H), AEF(PEG2PEG2-gEC160H), AEF(PEG2PEG2gEC180H), F(4-(2-(1PEG2_1PEG2_IsoGlu_Palm)aminoethoxy)), F(4-(2-(1PEG2_1PEG2_IsoGlu_C18_Diacid)aminoethoxy)), F(4-(2-(PEG4_PEG4_IsoGlu_Palm)aminoethoxy)), F(4-(2-(PEG12_IsoGlu_Palm)aminoethoxy)), F(4-(2-(PEG4_PEG4_IsoGlu_C18_Diacid)aminoethoxy)), or F(4-(2-(PEG12_IsoGlu_C18_Diacid)aminoethoxy)).

Formula IV

14. An interleukin-23 receptor inhibitor which comprises an amino acid sequence of Formula IV R1—X3—X4—X5—T—X7-KAc-X9—X10—X11—X12—X13—X14—X15—X16—R2 (IV)

wherein:

R1 is hydrogen, $C_1$ to $C_4$ alkyl C(O)—, or $C_1$ to $C_4$ alkyl C(O)— substituted with Cl, F, or cyano, or;

X3 is dR or absent;

X4 is Pen, aMeC, Abu, C;
X5 is N, A, dN, dA;
X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(4OCF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;
X9 is Pen, Abu, aMeC, or C;
X10 is F4OMe, F4CONH2, F, 2Nal, AEF, 4AmF, or 4OMeF;
X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;
X12 is aMeK-Z, Spiral_Pip, or K-Z;
X13 is KAc, E, A, L, dK, dKAc, dE, or dA;
X14 is N, L, A, dN, dL, or dA;
X15 is 3Pya, 3MeH, H, F, hF, Y, dY, Y(CHF2), PAF, oAMPhe, F(CF3), dPaf, D3Pya, ACIPA(SR), 6OH3Pya, 5PyrimidAla, 5MePyridinAla, 5MeH, 5AmPyridinAla, 4TriazolAla, 4PyridinAla, 4Pya, 3QuinolAla, 3OHPhe, 3AmPyrazolAla, 2AmTyr, or 1MeH;
X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P,or dP;and
R2 is —OH, —NH2, NH($C_1$ to $C_4$ alkyl), —NH($C_1$-$C_4$ alkyl), —N($C_1$ to $C_4$ alkyl)2, each alkyl optionally substituted with Cl, F, or cyano; and
Z is group comprising a lipid moiety; and
wherein the IL-23R inhibitor is cyclized by a disulfide or thioether first bond between X4 and X9.

15. The IL-23R inhibitor of aspect 14, wherein:
R1 is $C_1$ to $C_4$ alkyl C(O)—;
X3 is absent;
X5 is N or A;
X7 is 7MeW or W;
X1I is 2Nal;
X15 is 3Pya; and
X16 is Sarc.

16. The IL-23R inhibitor of aspect 14 or 15, wherein:
X4 is Pen, aMeC, or C;
X9 is Pen, C, or aMeC; and
the IL-23R inhibitor is cyclized by a disulfide first bond between X4 and X9.

17. The IL-23R inhibitor of any of aspects 14-16, wherein X12 is dKaMeK(PEG12IsoGluPalm), aMeK(PEG12IsoGluC18Diacid), K(PEG12IsoGluPalm), SpiralPipPEG12IsoGluPalm, K(PEG12IsoGluC18Diacid, aMeK(Peg4IsoGluC18Diacid), aMeK(PEG12C18Diacid), aMeK(Peg4IsoGluPalm), aMeK(IsoGluPalm), aMeK(IsoGluC18Diacid), aMeK(Peg4C18Diacid), aMeK(PEG2PEG2gEC18OH), aMeK(PEG2PEG2gEC16OH), or aMeK(PEG12gEC16).

Formula V

18. An interleukin-23 receptor inhibitor which comprises an amino acid sequence of Formula V

R1—X3—X4—X5—T—X7—X8—X9—X10—X11—THP—X13—X14—X15—X16—X17—R2 (V)

wherein:
R1 is hydrogen, $C_1$ to $C_4$ alkyl C(O)—, $C_1$ to $C_4$ alkyl C(O)— substituted with Cl, F, or cyano;
X3 is dR, dK, or absent;
X4 is Pen, Abu, or C;
X5 is N, K, Q, L, dN, dK, dL, or dQ;
X7 is 7MeW, W, 3Pya, 7(2ClPh)W, 7(3(1NMepip)pyraz)W, 7(3(6AzaInd1Me))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(4OCF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;
X8 is KAc, Q, K, dKAc, or dQ;
X9 is Pen, aMeC, Abu, or C;
X10 is AEF, AEF(G) or F4OMe;
X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;
X13 is K-Z, or dK-Z;
X14 is N, L, dN, or dL;
X15 is 3Pya, 3MeH, H, F, bAla, hF, Y, dY, Y(CHF2), PAF, oAMPhe, F(CF3), dPaf, D3Pya, ACIPA(SR), 6OH3Pya, 5PyrimidAla, 5MePyridinAla, 5MeH, 5AmPyridinAla, 4TriazolAla, 4PyridinAla, 4Pya, 3QuinolAla, 3OHPhe, 3AmPyrazolAla, 2AmTyr, or 1MeH;
X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P, dP or absent;
X17 is absent, or K-Z;
R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and
Z is group comprising a lipid moiety; and
wherein the IL-23R inhibitor is cyclized by a disulfide or thioether first bond between X4 and X9.

19. The IL-23R inhibitor of aspect 18 wherein:
X3 is absent;
X5 is N or A;
X7 is 7MeW or W;
X11 is 2Nal;
X13 is K-Z;
X15 is 3Pya, bAla, or F; and
X16 is Sarc or absent.

20. The IL-23R inhibitor of aspect 18 or 19: wherein:
(i) R1 further comprises a Z group;
(ii) either the K or dK group of X5 is substituted by a Z group to give K-Z or dK-Z; and/or
(iii) X17 is K(PEG2PEG2gEC16OH) or K(PEG2PEG2gEC18OH).

21. The IL-23R inhibitor of any of aspects 18 to 20, wherein:
X4 is Pen, aMeC, or C;
X9 is Pen, C, or aMeC; and
the IL-23R inhibitor is cyclized by a disulfide first bond between X4 and X9.

22. The IL-23R inhibitor of any of aspects 18-21, wherein X13 is K(1PEG2_1PEG2_IsoGlu_C16_Diacid), K(1PEG2_1PEG2_IsoGlu_C18_Diacid), K(COPent), K(COPent), K(PEG2PEG2gEC10OH), K(PEG2PEG2gEC10OH), K(gEC10OH), K(FITCPEG4), K(PEG2PEG2gEC12), K(PEG2PEG2gEC14), K(PEG2PEG2gEC12), K(PEG2PEG2gEC12), K(PEG2PEG2gEC12), K(PEG2PEG2gEC14), K(PEG2PEG2gEC12), K(PEG2PEG2gEC12), K(PEG2PEG2gEC12), K(PEG2PEG2gEC14), K(C14), or K(gEC14).

Formula VI

23. An interleukin-23 receptor inhibitor which comprises an amino acid sequence of Formula VI

R1—X3—X4—X5—T—X7—X8—X9—X10—X11—X12—X13—X14—X15—X16—X17—R2 (VI)

wherein

R1 is hydrogen, $C_1$ to $C_4$ alkyl C(O)—, or $C_1$ to $C_4$ alkyl C(O)— substituted with Cl, F, or cyano, cPEG3aCO, or 6Ahx;

X3 is dR, R, K, dK, dK-Z, K-Z, or absent;

X4 is Pen, Abu, aMeC or C;

X5 is N, or L;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is KAc, Q, dKAc, or dQ;

X9 is Pen, C, aMeC, or Abu;

X10 is AEF, F40Me, or TMAPF;

X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;

X12 is THP or Acvc, or Acpx;

X13 is KAc, dKAc, dE or E;

X14 is N or L;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, THP, or 1MeH;

X16 is K-Z, nMeK—Z, N—Z, Sarc-Z, dK-Z;

X17 is absent or K-Z;and

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and Z is group comprising a lipid moiety; and wherein the IL-23R inhibitor is cyclized by a disulfide or thioether first bond between X4 and X9, and an amide second bond between R1 and X13 when R1 is 6Ahx and X13 is E.

24. The IL-23R inhibitor of aspect 23, wherein:

X3 is dR, dK-Z, or absent;

X5 is N or A;

X7 is 7MeW or W;

X8 is KAc, or Q;

X11 is 2Nal;

X13 is KAc or E; and

X15 is 3Pya or THP.

25. The IL-23R inhibitor of any of aspects 23 to 24, wherein:

X4 is Pen, aMeC, or C;

X9 is Pen, C, or aMeC; and the IL-23R inhibitor is cyclized by a disulfide first bond between X4 and X9.

26. The IL-23R inhibitor of any of aspects 23-25, wherein X16 is N(4Am-Benzyl)-Gly, N(4AmBenzyl)Gly, 4diF-Pro, NMeK(PEG2PEG2PEG2PEG2gEC12), NMeK(PEG2PEG2gEC180H), K(PEG2PEG2gEC180H)Gly, K(PEG2PEG2-gEC180H), NMeK(PEG2PEG2-gEC160H), K(PEG2PEG2-gEC160H), NMeK(PEG2PEG2-gEC180H), dK(PEG12C18Diacid), dK(PEG12IsoGluPalm), dK(PEG12IsoGluC18Diacid), K(1PEG21PEG2IsoGluC18Diacid), K(1PEG21PEG2IsoGluC18), K(PEG2PEG2gEC18), K(PEG2PEG2gEC180H).

27. The IL-23R inhibitor of any of aspects 23 to 26, wherein X3 is dK(gEC180H), dK(PEG2gEC180H), dK(PEG2PEG2gEC180H), dK(PEG2PEG2gEC180H), or dK(PEG2PEG2PEG2PEG2gEC12)

28. The IL-23R inhibitor of any of aspects 22 to 26, wherein X3 is absent or dR.

Formula VII

29. An interleukin-23 receptor inhibitor which comprises an amino acid sequence of Formula VII

R1—X3—X4—X5—T—X7—X8—X9—X10—X11—X12—X13—X14—X15—X16—R2 (VII)

wherein:

R1 is hydrogen, $C_1$ to $C_4$ alkyl C(O)—, or $C_1$ to $C_4$ alkyl C(O)— substituted with Cl, F, or cyano, GABA, CF3CO, succiniccarnitine, or cPEG3aCO, X3 is dK, K, dK-Z, or K-Z;

X4 is Pen, aMeC, or C;

X5 is N, L, or E;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is KAc, K, K(Me)3, dKAc, or dK;

X9 is Pen, aMeC, or C;

X10 is AEF, F, F(4-OMe), or TMAPF;

X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;

X12 is THP, aMeL, Acvc, or Acpx;

X13 is KAc, dKAc, L, E, dE, K(NMeAc), dK(Me)3, or K(Me)3;

X14 is N or L;

X15 is 3Pya, THP, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P, dP, Sarc, or absent;

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and Z is group comprising a lipid moiety; and wherein the IL-23R inhibitor is cyclized by a disulfide first bond between X4 and X9.

30. The IL-23R inhibitor of aspect 29, wherein:
X7 is 7MeW or W;
X8 is KAc, K, or $K(Me)_3$;
X11 is 2Nal;
X15 is 3Pya or THP; and
X16 is Sarc, or absent.

31. The IL-23R inhibitor of any of aspects aspect 29 to 30, wherein:
R1 further comprises a Z group.

32. The IL-23R inhibitor of aspect 31, wherein the Z group is C12gEPEG2PEG2CO, or C14gEPEG2PEG2CO.

33. The IL-23R inhibitor of any of aspects aspect 29 to 32, wherein:
when X5 is E and X10 is AEF, the IL-23R inhibitor further comprises an amide second bond cyclizing the inhibitor.

34. The IL-23R inhibitor of any of aspects aspect 29 to 32, wherein: when R1 comprises GABA and X13 is E, the IL-23R inhibitor further comprises an amide second bond cyclizing the inhibitor. 35. The IL-23R inhibitor of any of aspects 29-34, wherein X3 is dK(1PEG21PEG2IsoGluC16Diacid), dK(1PEG21PEG2IsoGluC18Diacid), dK(DAP (C160H)2), dK(gEC16), dK(gEC16), dK(gEC18), dK(gEC18), dK(gEC180H), dK(GolAC16), dK(GolAC160H), dK(GolAC180H), dK(IsoGluC18Diacid), dK(PEG12C18Diacid), dK(PEG12IsoGluC18Diacid), dK(PEG12IsoGluPalm), K(PEG120Me), dK(PEG2 Sp6 PEG2 gE C180H), dK(PEG2gEC180H), dK(PEG2PEG2 C180H), dK(PEG2PEG2 gE C180H (c), dK(PEG2PEG2 gE C180H(C), dK(PEG2PEG2 gE Sp6 C180H), dK(PEG2PEG2 gE(C) C180H, dK(PEG2PEG2GolAC180H), dK(PEG2PEG2-C18Go1B), dK(PEG2PEG2C180H), dK(PEG2PEG2gE(C)C12), dK(PEG2PEG2gE(c) C180H), dK(PEG2PEG2gEC100H), dK(PEG2PEG2-gEC100H), dK(PEG2PEG2gEC12), dK(PEG2PEG2gEC120H(C)), dK(PEG2PEG2gEC12OH(c)), dK(PEG2PEG2gEC14), dK(PEG2PEG2-gEC16), dK(PEG2PEG2gEC160H), dK(PEG2PEG2-gEC160H), dK(PEG2PEG2gEC18), dK(PEG2PEG2-gEC18), dK(PEG2PEG2gEC180H), dK(PEG2PEG2-gEC180H), K(PEG2PEG2gEC200H), dK(PEG2PEG2gEDab(mXOH)2), K(PEG2PEG2-gE-DAP(pXOH)2), dK(PEG2PEG2gEmXOH), dK(PEG2PEG2-gEmXOH), dK(PEG2PEG2-gEpXOH), dK(PEG2PEG2-gETrxC180H), dK(PEG2PEG2-gETrxC200H), dK(PEG2PEG2-PEG2PEG2gEC12), dK(PEG2PEG2-PgEC180H), dK(PEG2PEG2-pgEC180H), dK(PEG2PEG2-PPPgEC180H), dK(PEG2PEG2-pppgEC180H), dK(PEG2PEG2SP6gEC180H), dK(PEG2PEG2-TrxgEC180H), dK(PEG2PEG6-gEC180H), K(PEG4), dK(Peg4C18Diacid, dK(Peg4IsoGluC18Diacid), dK(PEG6 gE C180H), dK(Sp6 PEG2PEG2gE C180H), or $dKPEG2PEG2\text{-}gEDAP(C160H)_2$.

Formula VIII

36. An interleukin-23 receptor inhibitor which comprises an amino acid sequence of VIII

R1—X3—X4—X5—T—X7—X8—X9-AEF-X11—THP—X13—N—X15—X16—X17—R2 (VIII)

wherein:
R1 is hydrogen, $C_1$ to $C_4$ alkyl C(O)—, or $C_1$ to $C_4$ alkyl C(O)— substituted with Cl, F, or cyano, C12gEPEG2PEG2CO, C1AcPEG4CO;
X3 is dR, R, dK(SP6), K(SP6), K, or dK;
X4 is Pen, Abu, aMeC or C;
X5 is N or E;
X7 is 7MeW, W, 3Pya, 7(2C1Ph)W, 7(3(1NMepip) pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7 (124TAZP))W, 7(7Imzpy)W, 7BrW, 7EtW, 7PhW, 7PyrW, A, DT, or D7MeW;
X8 is Kac;
X9 is Pen, C, aMeC, or Abu;
X11 is 2-Nal, Phe(2-Me), Phe(3-Me), Phe(4-Me), Phe (3,4-dimethoxy), 2Quin, 3Quin, 1-Nal, unsubstituted Trp, or Trp substituted with cyano, halo, alkyl, haloalkyl, hydroxy, or alkoxy;
X13 is E, dE, K, or dK;
X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;
X16 is meG, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P, dP, or absent;
X17 is K—Z or dK-Z; or
R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and
Z is group comprising a lipid moiety; and
wherein the IL-23R inhibitor is cyclized by a disulfide or thioether first bond between X4 and X9, and an amide second bond when X5 is E and X10 is AEF.

37. The IL-23R inhibitor of aspect 36, wherein:
X7 is 7MeW or W;
X11 is 2Nal;
X15 is 3Pya; and
X16 is sarc or absent.

38. The IL-23R inhibitor of any of aspects 36 to 37, wherein:
X4 is Pen, aMeC, or C;
X9 is Pen, C, or aMeC; and the IL-23R inhibitor is cyclized by a disulfide first bond between X4 and X9

39. The IL-23R inhibitor of any of aspects 36 to 38, wherein X17 is K(PEG2PEG2gEC180H), K(PEG2PEG2-gEC160H), K(1PEG21PEG2IsoGluC16Diacid), K(1PEG21PEG2IsoGluC18Diacid), K(PEG2PEG2gEC200H), K(PEG2PEG2gEC12), or K(PEG2NMePEG2NMegENMeC18Tetrazole).

Formula IX

40. An interleukin-23 receptor inhibitor which comprises an amino acid sequence of Formula IX

R1—X4—X5—T—X7—X8—X9-AEF-X11—THP—X13—N—X15—X16—X17—R2 (IX)

wherein:
R1 is hydrogen, $C_1$ to $C_4$ alkyl C(O)—, or $C_1$ to $C_4$ alkyl C(O)— substituted with Cl, F, or cyano, 5Ava, AEEP or C14gEPEG2PEG2CO;

X4 is Pen, Abu, C, aMeC, or absent;

X5 is N or absent;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is KAc, dK, dQ, or Q;

X9 is Pen, S5H, C, or aMeC;

X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;

X13 is E, KAc, dK(d), S5H, dE, dK(Ac), dK, or R5H;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, or 1MeH;

X16 is Sarc, 4(R)HydroxyPro, 4(S)AminoPro, 4diF-Pro, 5(R)diMePro, aMeP, N(3AmBenzyl)Gly, N(Cyclohexyl)Gly, N(Isobutyl)Gly, P,or dP;

X17 is K-Z;

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano; and Z is group comprising a lipid moiety; and wherein the IL-23R inhibitor is cyclized by a disulfide or thioether first bond between X4 and X9 or an aliphatic bond (generated from a Ring Closing Metathesis "RCM" reaction) between X9 and X13 when both residues are S5H.

41. The IL-23R inhibitor of aspect 40, wherein:

X7 is 7MeW or W;

X11 is 2Nal;

X15 is 3Pya; and

X16 is Sarc.

42. The IL-23R inhibitor of any of aspects 40 to 41, wherein:

the IL-23R inhibitor comprises a second amide bond between R1 and X13 when R1 is 5Ava or AEEP and X13 is E.

43. The IL-23R inhibitor of any of aspects 40 to 42, wherein:

R1 further comprises a Z group.

44. The IL-23R inhibitor of any of aspects 40 to 43, wherein X17 is K(PEG2PEG2gEC180H), K(PEG2PEG2gEC160H), K(PEG2PEG2gEC200H), K(PEG2PEG2gEC14), K(PEG2PEG2gEC12), K(gEC14), K(C14), K(gEC12), K(PEG2PEG2gEDProC14), K(PEG2PEG2C14), K(GSGSGSGC14), K(PEG2PEG2SP6C14), K(PEG2C14), K(PEG2PEG2gESarC14), or K(PEG2PEG2gEProC14.

45. The IL-23R inhibitor of any of aspects 40 to 43, wherein X17 is K(PEG2PEG2gEC180H), K(PEG2PEG2gEC160H), K(PEG2PEG2gEC200H), K(PEG2PEG2gEC14), K(PEG2PEG2gEC12), K(C14), K(gEC12), K(PEG2PEG2gEDProC14), K(PEG2PEG2C14), K(GSGSGSGC14), K(PEG2PEG2SP6C14), K(PEG2C14), K(PEG2PEG2gESarC14), or K(PEG2PEG2gEProC14).

Formula X

46. An interleukin-23 receptor inhibitor which comprises an amino acid sequence of Formula X

R1—X3—X4—X5—T—X7—X8—X9—X10—X11—X12—X13—X14—X15—X16—X17—R2 (X)

wherein:

R1 is hydrogen, $C_1$ to $C_4$ alkyl C(O)—, or $C_1$ to $C_4$ alkyl C(O)— substituted with Cl, F, or cyano, 7Ahp, 6Ahx, 5Ava, 6Ava, AEEP, GABA, succinylcarnitine. cPEG3aCO, C1AcPEG4CO, 1PEG2_1PEG2_IsoGlu_C18, 1PEG2_1PEG2_IsoGlu_C18_Diacid, PentCO, PEG12_OMe, HOC18gEPEG2PEG2, PEG2PEG2gEC160H, PEG4_Decyl, PEG4_Lauryl, PEG4_Capryl, PEG4_Hexyl, PEG2_Palm, PEG2_Myristyl, PEG2_Lauryl, Hexyl, Decyl, PEG2_Decyl, PEG2_Capryl, Oct, PEG4_Palm, Palm, Lauryl, 1PEG2_1PEG2_IsoGlu_C16_Diacid, HOC16gEPEG2PEG2orn, or Z;

X3 is dR, dK, dK-Z, or absent;

X4 is Pen, aMeC, Abu, or C;

X5 is N, L, Q, K, E, aMeN, dN, dL, dQ, dK, dE, K-Z, or dK-Z;

X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;

X8 is KAc, dK(Ac), dQ, or Q;

X9 is Pen, C, aMeC, or Abu;

X10 is AEF, F40Me, F(4—CONH2), TMAPF, AEF(G), or F;

X11 is 2-Nal, Phe(2-Me), Phe(3-Me), Phe(4-Me), Phe(3,4-dimethoxy), 2Quin, 3Quin, 1-Nal, unsubstituted Trp, or Trp substituted with cyano, halo, alkyl, haloalkyl, hydroxy, or alkoxy;

X12 is THP, aMeL, Acvc, Acpx, aMeK, or aMeK-Z;

X13 is K(Ac), dK(Ac), E, dE, L, dL, dK-Z, or K-Z;

X14 is N, K, or K-Z;

X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, THP, NH(2-(pyridin-3-yl)ethyl), bAla, THP, aMeF, or 1MeH;

X16 is Sarc, K-Z, NMeK-Z, or absent;

X17 is K-Z, dK-Z, or absent;

R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, cyano or Z;

Z is group comprising a lipid moiety; and wherein the IL-23R inhibitor is cyclized by a disulfide or thioether first bond between X4 and X9, and an amide second bond (i) between X5 and X10 when X5 is E and X10 is AEF, or (ii) between X13 and R1 when X13 is E and R1 is 7Ahp, 6Ahx, 5Ava, 6Ava, AEEP, or GABA.

47. The IL-23R inhibitor of aspect 46, wherein:
   R1 is hydrogen, $C_1$ to $C_4$ alkyl C(O)—, or $C_1$ to $C_4$ alkyl C(O)— substituted with Cl, F, or cyano;
   X3 is dR, or dK-Z;
   X4 is Pen, aMeC, or C;
   X5 is N, L, Q, or K;
   X7 is 7MeW, W, 3Pya, 7(2ClPh)W, 7(3(1NMepip)pyraz)W, 7(3(6AzaIndlMe))W, 7(3CF3TAZP)W, 7(3NAcPh)W, 7(3NPyrazPh)W, 7(3NpyrlonePh)W, 7(3UrPh)W, 7(4(CpCNPh))W, 7(4CF3Ph)W, 7(4NAcPh)W, 7(40CF3Ph)W, 7(4OMePh)W, 7(4Paz)W, 7(5(2(4OMePh)Pyr))W, 7(5(Ina7Pyr))W, 7(6(1)7dMeNDAZ))W, 7(6(2MeNDAZ))W, 7(7(124TAZP))W, 7(7Imzpy)W, 7BrW, 7EtW, 7PhW, 7PyrW, A, DT, or D7MeW;X8 is KAc, or Q;
   X9 is Pen, C, or aMeC;
   X10 is AEF, F40Me, F(4—CONH2), or F;
   X11 is 2-Nal, Phe(2-Me), Phe(3-Me), Phe(4-Me), Phe(3,4-dimethoxy), 2Quin, 3Quin, or 1-Nal;
   X12 is THP;
   X13 is KAc, E, or L;
   X14 is N, or K;
   X15 is 3Pya, 3MeH, H, F, hF, Y, dY, Y(CHF2), PAF, oAMPhe, F(CF3), dPaf, D3Pya, ACIPA(SR), 60H3Pya, 5PyrimidAla, 5MePyridinAla, 5MeH, 5AmPyridinAla, 4TriazolAla, 4PyridinAla, 4Pya, 3QuinolAla, 30HPhe, 3AmPyrazolAla, 2AmTyr, THP, NH(2-(pyridin-3-yl)ethyl), bAla, or aMeF, or 1MeH;
   X16 is Sarc or absent;
   X17 is K-Z, or dK-Z;
   R2 is —OH, —NH2, —NH($C_1$ to $C_4$ alkyl), —NH($C_1$-$C_4$ alkyl), or —N($C_1$ to $C_4$ alkyl)2, each alkyl optionally substituted with Cl, F, or cyano
   Z is group comprising a lipid moiety; and
   wherein the IL-23R inhibitor is cyclized by a disulfide or thioether first bond between X4 and X9.
48. The IL-23R inhibitor of any of aspects 46 to 47, wherein:
   X7 is 7MeW or W;
   X11 is 2Nal or 3Quin;
   X15 is 3Pya, THP, H, NH(2-(pyridin-3-yl)ethyl), bAla, F, or aMeF; and
   X16 is Sarc; and
   R2 is —OH —NH2, —N(H)$C_1$-$C_4$ alkyl.
49. The IL-23R inhibitor of any of aspects 46 to 47, wherein X7 is 7MeW or W.
50. The IL-23R inhibitor of any of aspects 46 to 47, wherein X11 is 2Nal or 3Quin.
51. The IL-23R inhibitor of any of aspects 46 to 47, wherein X11 is 2Nal or 3Quin.
52. The IL-23R inhibitor of any of aspects 46 to 51, wherein the Z group of X17 is selected from the group consistsing of PEG2, PEG2PEG2gEC180H, PEG2PEG2eKC180H, PEG2PEG2gDabC180H, dK(PEG12IsoGluC18Diacid), dK(Peg4IsoGluPalm), dK(IsoGluPalm), dK(PEG12C18Diacid), dK(Peg4IsoGluC18Diacid), and dK(PEG12IsoGluPalm), dK(Peg4C18Diacid, dK(IsoGluC18Diacid).
53. The IL-23R inhibitor of any of aspects 46 to 52, wherein the Z group of X17 is selected from the group consistsing of PEG2PEG2gEC180H, PEG2PEG2eKC180H, PEG2PEG2gDabC180H, dK(PEG12IsoGluC18Diacid), and dK(Peg4IsoGluPalm).
54. An IL-23R inhibitor of any of aspects 1-50, wherein each Z is selected independently from a Z1 to Z5 group:
   Z1 is

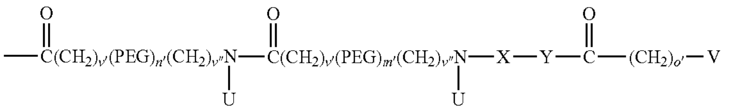

wherein:
   PEG is —$OCH_2CH_2$—;
   n'=0 or 2-24, when n' is 0 the group is absent and replaced by a bond;
   m'=0 or 2-24, when m' is 0 the group is absent and replaced by a bond;
   v' is independently selected from the range of 1-4 for each occurrence;
   v" is independently selected from the range of 0-4 for each occurrence, when v" is 0 the group is replaced by a bond;
   x=gE, dgE, 4SB, p, P, ppp, PPP, gE-(c), gE-(C), sp6, gDab, eK, Trx, or absent;
   o'=6-18;
   Y=gE, sp6, GolA, Pro, D-Pro, meG, Dab, Trx, or absent;
   U is hydrogen or methyl;
   V=—COOH, tetrazole, GolB, mXOH, pXOH, OPhenyl, carnitine, d-carnitine, or hydrogen.
   Z2 is

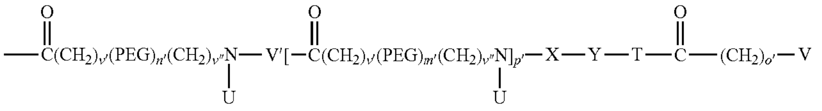

wherein:
   PEG is —$OCH_2CH_2$—;
   n'=0 or 2-24, when n' is 0 the group is absent and replaced by a bond;
   m' is independently selected from 0 or the range of 2-24 for each occurrence, when m' is 0 the group is replaced by a bond;
   v' is independently selected from the range of 1-4 for each occurrence;
   v" is independently selected from the range of 0-4 for each occurrence, when v" is 0 the group is replaced by a bond;

p' is 1-3;

V' is sp6, gEgE

X=gE, dgE, 4SB, p, P, ppp, PPP, gE-(c), gE-(C), sp6, gDab, eK, Trx, or absent;

Y=gE, sp6, GolA, Pro, D-Pro, meG, Dab, Trx, or absent;

X=Trx;

U is hydrogen or methyl;

o'=6-18;

V=—COOH, tetrazole, GolB, mXOH, pXOH, OPhenyl, carnitine, d-carnitine, or hydrogen;

Z3 is gE-C(O)$(CH_2)_{6-10}CH_3$, or -gE-C(O)$(CH_2)$1i-is$CH_3$;

Z4 is

—C(O)$(CH_2)_{6-18}$COOH or —C(O)$(CH_2)_{6-18}$COO(C1-4 alkyl);

Z5 is:

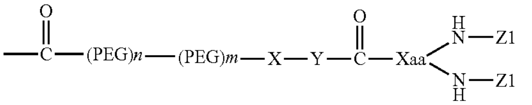

or

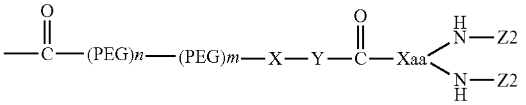

wherein:

n and m are independently selected from the range of 0 to 24;

X is absent or is selected from the group consising of E, dgE, 4SB, gE-(c), gE-(C), sp6, gDab, eK, or Trx;

Y is absent or is selected from the group consising of E, dgE, 4SB, gE-(c), gE-(C), sp6, gDab, eK, or Trx;

Xaa is a diamino-carboxylic acid; and

Z1 an Z2 are defined above.

55. An IL-23R inhibitor of any of aspects 1-50, wherein at least one Z is selected from Z1, Z2, Z3, and Z4.

56. A IL-23R inhibitor of any of aspects 1-50, wherein at least one Z is a Z5.

57. An IL-23R inhibitor selected from Table 1A, Table 1B, Table 1C, Table 1D, Table 1E, Table 1F, Table 1G, Table 1H, Table 11, Table 1J, Table 1K, Table 1L, or Table 1M respectively.

58. An IL-23R inhibitor selected from the group consisting of: Example 2 (compound 2 SEQ ID NO:2); Example (SEQ ID NO:4); Example 11 (SEQ ID NO:11); Example 17 (SEQ ID NO:17); Example 18 (SEQ ID NO:18); Example 19 (SEQ ID NO:19); Example 20 SEQ ID NO:20); Example 21 SEQ ID NO:21); Example 23 (SEQ ID NO:23); and Example 24 (SEQ ID NO:24).

59. The IL-23R inhibitor of any preceding aspect wherein the interleukin-23 receptor is a human interleukin receptor.

60. A pharmaceutically acceptable salt, solvate, or form thereof of an IL-23R inhibitor of any of aspects 1-59.

61. A pharmaceutical composition which comprises:

(i) peptide inhibitor of an interleukin-23 receptor or pharmaceutically acceptable salt, solvate, or form thereof according to any one of aspects 1-56, and (ii) a pharmaceutically acceptable carrier, excipient, or diluent.

62. A pharmaceutical composition which comprises:

(i) peptide inhibitor of an interleukin-23 receptor or pharmaceutically acceptable salt, solvate, or form thereof according to any one of aspect 57, and (ii) a pharmaceutically acceptable carrier, excipient, or diluent.

63. A pharmaceutical composition which comprises:

(i) peptide inhibitor of an interleukin-23 receptor or pharmaceutically acceptable salt, solvate, or form thereof according to aspect 58; and (ii) a pharmaceutically acceptable carrier, excipient, or diluent.

64. The use of a peptide inhibitor of an interleukin-23 receptor according to any of aspects 1-59 for the preparation of a medicament.

65. The use of a peptide inhibitor of an interleukin-23 receptor according to any of aspects 1-59, or a pharmaceutical composition according to any of aspects 60-63, for the preparation of a medicament for the treatment of an inflammatory disorder or autoimmune inflammatory disorder.

66. The use of a peptide inhibitor of an interleukin-23 receptor according to any of aspects 1-59, or a pharmaceutical composition according to any of aspects 60-63, for the preparation of a medicament for the treatment of autoimmune inflammation and related diseases and disorders including, but not limited to: multiple sclerosis, asthma, rheumatoid arthritis, inflammation of the gut, inflammatory bowel diseases (IBDs), juvenile IBD, adolescent IBD, Crohn's disease, ulcerative colitis, Celiac disease (nontropical Sprue), microscopic colitis, collagenous colitis, eosinophilic gastroenteritis/esophagitis, colitis associated with radio- or chemo-therapy, colitis associated with disorders of innate immunity as in leukocyte adhesion deficiency-1, sarcoidosis, Systemic Lupus Erythematosus, ankylosing spondylitis (axial spondyloarthritis), psoriatic arthritis, psoriasis (e.g., plaque psoriasis, guttate psoriasis, inverse psoriasis, pustular psoriasis, Palmo-Plantar Pustulosis, psoriasis vulgaris, or erythrodermic psoriasis), atopic dermatitis, acne ectopica, enteropathy associated with seronegative arthropathies, chronic granulomatous disease, glycogen storage disease type 1b, Hermansky-Pudlak syndrome, Chediak-Higashi syndrome, Wiskott-Aldrich Syndrome, pouchitis, pouchitis resulting after proctocolectomy and ileoanal anastomosis, gastrointestinal cancer, pancreatitis, insulin-dependent diabetes mellitus, mastitis, cholecystitis, cholangitis, primary biliary cirrhosis, viral-associated enteropathy, pericholangitis, chronic bronchitis, chronic sinusitis, asthma, uveitis, or graft versus host disease.

67. The use of aspect 66, wherein the diseases or disorders are selected from Inflammatory Bowel Disease (IBD), Ulcerative colitis (UC), Crohn's Disease (CD), psoriasis (PsO) or psoriatic arthritis (PsA).

68. A method for treating a disease or disorder associated with Interleukin 23 (IL-23) or the Interleukin 23 Receptor (IL-23R), which comprises administering:

(i) an effective amount of a peptide inhibitor of an interleukin-23 receptor, or a pharmaceutically acceptable salt, solvate, or form thereof according to any one of aspects 1-59; or (ii) a pharmaceutical composition according to any one of aspects 60-63, respectively to a patient in need thereof.

69. The method of aspect 68, wherein the disease or disorder is associated with autoimmune inflammation.

70. The method of aspect 68, wherein the disease or disorder is associated with multiple sclerosis, asthma, rheumatoid arthritis, inflammation of the gut, inflammatory bowel diseases (IBDs), juvenile IBD, adolescent IBD, Crohn's disease, ulcerative colitis, Celiac disease (nontropical Sprue), microscopic colitis, collagenous colitis, eosinophilic gastroenteritis/esophagitis, colitis associated with radio- or chemo-therapy, colitis associated with disorders of innate immunity as in leukocyte adhesion deficiency-1, sarcoidosis, Systemic Lupus Erythematosus, ankylosing spondylitis (axial spondyloarthritis), psoriatic arthritis, psoriasis (e.g., plaque psoriasis, guttate psoriasis, inverse psoriasis, pustular psoriasis, Palmo-Plantar Pustulosis, psoriasis vulgaris, or erythrodermic psoriasis), atopic dermatitis, acne ectopica, enteropathy associated with seronegative arthropathies, chronic granulomatous disease, glycogen storage disease type 1b, Hermansky-Pudlak syndrome, Chediak-Higashi syndrome, Wiskott-Aldrich Syndrome, pouchitis, pouchitis resulting after proctocolectomy and ileoanal anastomosis, gastrointestinal cancer, pancreatitis, insulin-dependent diabetes mellitus, mastitis, cholecystitis, cholangitis, primary biliary cirrhosis, viral-associated enteropathy, pericholangitis, chronic bronchitis, chronic sinusitis, asthma, uveitis, or graft versus host disease.
71. The method of aspect 68, wherein the disease or disorder is associated with Ulcerative colitis (UC), Crohn's Disease (CD), psoriasis (PsO), or psoriatic arthritis (PsA).
72. The method of aspect 68, wherein the disease or disorder is Ulcerative colitis (UC).
73. The method of aspect 68, wherein the disease or disorder is Crohn's Disease (CD).
74. The method of aspect 68, wherein the disease or disorder is psoriasis (PsO).
75. The method of aspect 68, wherein the disease or disorder is psoriatic arthritis (PsA).
76. A kit which comprises a peptide inhibitor of an interleukin-23 receptor of any of aspects 1-59, or a pharmaceutical composition according to any of aspects 60 to 63, and instructions for the use of the inhibitor of an interleukin-23 receptor or pharmaceutical composition.
77. The kit of aspect 76, wherein the instructions are directed to the treatment of an inflammatory disease or disorder.
78. The kit of aspect 77, wherein the disease is inflammatory bowel disease (IBD), Crohn's disease (CD), ulcerative colitis (UC), psoriasis (PsO), and psoriatic arthritis (PsA).

The IL-23R inhibitors of aspects 1-60 may comprise amino aids of the D-isomer configuration at one or more positions. The IL-23R inhibitors of aspects 1-60, may comprise D-isomer only at: (i) one or more of positions X3, X5, X6, X8 and X13, and optionally one of positions X1—X2, X4, X7, X9 to X12, X14—X18 present in the inhibitor; or (ii) one or more of positions X3, X8 and X13, and optionally at one of positions X1—X2, X4—X7, X9 to X12, X14-X18 present in the inhibitor. The IL-23R inhibitors of aspects 1-60, may comprise D-isomer only at (i) X3, and optionally at one of positions X1—X2, X4—X18 present in the inhibitor; or (ii) one of positions X3, and X8, and optionally one of positions X1—X2, X4—X7, X9—X18 present in the inhibitor. The IL-23R inhibitors of aspects 1-60, may comprise D-isomer only at one or two of positions X1 to X18 appearing in the IL-23R inhibitors set forth herein. The IL-23R inhibitors of aspects 1-60, may comprise D-isomer only at only three or four of positions X1 to X18 appearing in the IL-23R inhibitors set forth herein. The IL-23R inhibitors of aspects 1-60, may comprise D-isomer at only five or six of positions X1 to X18 appearing in the IL-23R inhibitors set forth herein. IL-23R inhibitors with amino aids of the D-isomer confiuration may be used in any of the pharmaceutical formulations, methods or uses of aspects 61-78.

V. Examples

The following examples illustrate the invention. These examples are not intended to limit the scope of the present invention, but rather to provide guidance to the skilled artisan to prepare and use the compounds, compositions, and methods of the present invention. While particular aspects of the present invention are described, the skilled artisan will appreciate that various changes and modifications can be made without departing from the spirit and scope of the invention.

Some abbreviations useful in describing the invention are defined below in the following Table 2A and Table 2B.

TABLE 2A

Amino Acid Abbreviations

| Abbreviation | Definition | Smiles |
|---|---|---|
| dR, arg, or r | D-Arginine | |
| dK, (D)Lys, (D)-Lys, lys, or k | D-lysine | |
| 5 Apa | 5AminoPentanoicAcid | |
| 2-Nal or 2Nal | 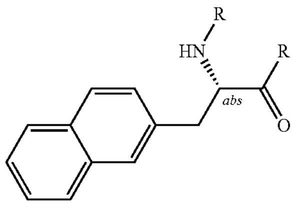 $C_{13}H_{11}NOR_2$ | O=C([C@H](Cc1cc2ccccc2cc1)N[R])[R] |

TABLE 2A-continued

| Amino Acid Abbreviations | | |
|---|---|---|
| Abbreviation | Definition | Smiles |
| 3MeH | 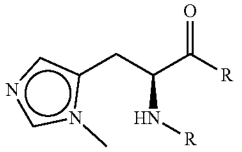<br>3-methyl-L-histidine | Cn1cncc1C[C@H](N[R])C([R])=O |
| 3Pya, 3Pal, 3-(2-pyridyl)-alanine | 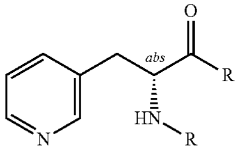 | O=C([C@H](Cc1cnccc1)N[R])[R] |
| THP, 4-aminotetrahydro-2H-pyran-4-carboxylic acid | 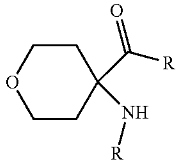<br>4-amino-4-carboxy-tetrahydropyran | O=C(C1(CCOCC1)N[R])[R] |
| 7PhW, 7PhTrp or W(7-Ph) | 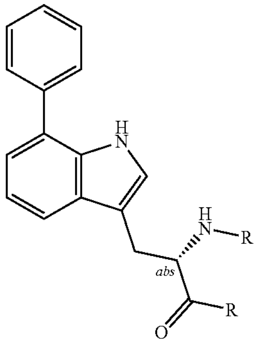<br>7-phenyl-L-tryptophan | O=C([C@H](Cc1c[nH]c2c1cccc2-c1ccccc1)N[R])[R] |
| 7MeW, 7(MeW), 7MeTrp, 7-methyl-L-tryptophan | 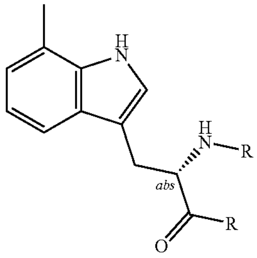<br>7-methyl-L-tryptophan | Cc1cccc2c1[nH]cc2C[C@@H](C([R])=O)N[R] |
| Abu | 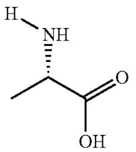<br>2-aminobutyric acid | C[C@@H](C=O)N |

TABLE 2A-continued

| Amino Acid Abbreviations | | |
|---|---|---|
| Abbreviation | Definition | Smiles |
| AEF, Phe(4-(2-aminoethoxy)), or F(4-2ae) | 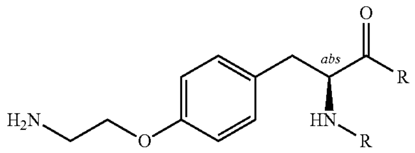<br>4-(2-aminoethoxy)-L-phenylalanine | NCCOc1ccc(C[C@@H](C([R])=O)N[R])cc1 |
| Ahp, 7Ahp, 7AHP, or 7AHP(2) | 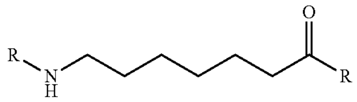<br>7-aminoheptanoic acid | O=C([R])CCCCCCN[R] |
| Ahx or 6Ahx, 6Ahx, 6Ahx(2), 6-aminohexanoic acid | 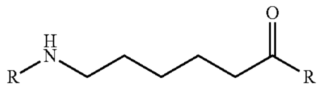<br>6-aminohexanoic acid | O=C(CCCCCN[R])[R] |
| aMeF, aMePhe, or aMe-Phe | 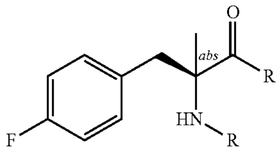<br>alpha-methyl L-phenylalanine | C[C@](Cc(cc1)ccc1F)(C([R])=O)N[R] |
| aMeK, aMeLys, or aMe-Lys | alpha-methyl L-lysine | |
| Arg or R | L-arginine | |
| dR, arg, r or (D)Arg | D-arginine | |
| Asn or N | L-asparagine | |
| Ava, 5Ava(2), or 5Ava | 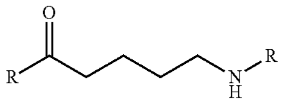<br>5-Aminovaleric Acid | O=C(CCCCN[R])[R] |
| bAla, b-ALA, beta-Alanine, bA | 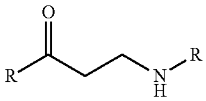<br>beta-alanine | O=C(CCN[R])[R] |
| Bis-amino-PEG2 | 1,2-bis(2-aminoethoxy)ethane | |
| Cys or C | L-cysteine | |
| Dbu, Dab, (S)-2,4-diaminobutanoic acid, or DAB | 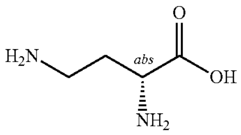<br>L-2,4-diaminobutyric acid | NCC[C@@H](C(O)=O)N |

TABLE 2A-continued

| Abbreviation | Definition | Smiles |
|---|---|---|
| Amino Acid Abbreviations | | |
| Dap, Dap, DAP, Dpr or (S)-2,3-diaminopropanoic acid | 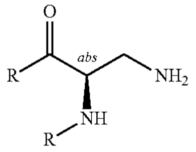 L-2,3-diaminopropionic acid | NC[C@@H](C([R])=O)N[R] |
| dDab, D(Dab), dDpr, (R)-2,3-diaminopropanoic acid | 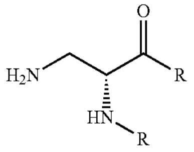 D-2,4-diaminobutyric acid | NC[C@H](C([R])=O)N[R] |
| dDap, D(Dap), dDap, dap, dDbu, (R)-2,3-diaminopropanoic acid | 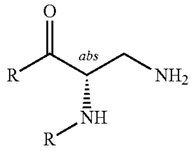 D-2,3-diaminopropionic acid | NC[C@H](C([R])=O)N[R] |
| Fmoc-2Nal | 2-((((9H-fluoren-9-yl)methoxy)carbonyl)amino)-3-(naphthalen-2-yl)propanoic acid | |
| Fmoc-3Pya | (S)-2-((((9H-fluoren-9-yl)methoxy)carbonyl)amino)-4-(pyridin-3-yl)butanoic acid | |
| Fmoc-7MeW | (S)-2-((((9H-fluoren-9-yl)methoxy)carbonyl)amino)-3-(7-methyl-1H-indol-3-yl)propanoic acid | |
| Fmoc-AEF | (S)-2-((((9H-fluoren-9-yl)methoxy)carbonyl)amino)-3-(4-(2-((tert-butoxycarbonyl)amino)ethoxy) phenyl)propanoic acid | |
| Fmoc-aMePhe | (((9H-fluoren-9-yl)methoxy)carbonyl)-alphamethyl-L-phenylalanine | |
| Fmoc-arg or Fmoc-r | N-alpha-(9-fluorenylmethyloxycarbonyl)-N'-2,2,4,6,7-pentamethyldihydrobenzofuran-5-sulfonyl-D-arginine | |
| Fmoc-Asn or Fmoc-N | $N^2$-(((9H-fluoren-9-yl)methoxy)carbonyl)-N4-trityl-L-asparagine | |
| Fmoc-Dap(DDe) | N2-(Fmoc)-N6-(1-(4,4-dimethyl-3,5-dioxocyclohexylidene)ethyl)-L-Dap | |
| Fmoc-DDe-Lys(Fmoc)-OH | N6-(((9H-fluoren-9-yl)methoxy)carbonyl)-N2-(1-(4,4-dimethyl-3,5-dioxocyclohexylidene)ethyl)-L-lysine | |
| Fmoc-Glu or Fmoc-E | (S)-2-((((9H-fluoren-9-yl)methoxy)carbonyl)amino)-5-(tert-butoxy)-2-methyl-5-oxopentanoic acid | |
| Fmoc-Lys(Ac) or Fmoc-K(Ac) | N2-(((9H-fluoren-9-yl)methoxy)carbonyl)-N6-acetyl-L-lysine | |

TABLE 2A-continued

| Amino Acid Abbreviations | | |
|---|---|---|
| Abbreviation | Definition | Smiles |
| Fmoc-Lys(DDe) or Fmoc-K(DDe) | N2-(Fmoc)-N6-(1-(4,4-dimethyl-3,5-dioxocyclohexylidene)ethyl)-L-lysine | |
| Fmoc-Lys(NMeAc) or Fmoc-K(NMeAc) | N2-(((9H-fluoren-9-yl)methoxy)carbonyl)-N6-acetyl-N6-methyl-L-lysine | |
| Fmoc-NMeLys(DDe) or Fmoc-NMeK(DDe) | (9H-fluoren-9-yl)methyl (1-amino-6-((1-(4,4-dimethyl-3,5-dioxocyclohexylidene)ethyl)amino)-1-oxohexan-2-yl)(methyl)carbamate | |
| Fmoc-Pen-Trt | (R)-2-((((9H-fluoren-9-yl)methoxy)carbonyl)amino)-3-methyl-3-(tritylthio)butanoic acid | |
| Fmoc-Pro or Fmoc-P | Fmoc-proline-OH | |
| Fmoc-pro or Fmoc-p | Fmoc-D-proline-OH | |
| Fmoc-R5H | (R)-2-((((9H-fluoren-9-yl)methoxy)carbonyl)amino)hept-6-enoic acid | |
| Fmoc-Sar or Fmoc-Sarc | N-(((9H-fluoren-9-yl)methoxy)carbonyl)-N-methylglycine | |
| Fmoc-THP | 4-((((9H-fluoren-9-yl)methoxy)carbonyl)amino) tetrahydro-2H-pyran-4-carboxylic acid | |
| Fmoc-Thr or Fmoc-T | N-(((9H-fluoren-9-yl)methoxy)carbonyl)-O-(tert-butyl)-L-threonine | |
| GABA, Gaba, Gaba(2), Gaba2, or 4Abu | 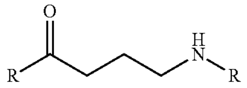 4-aminobutyric acid | O=C(CCCN[R])[R] |
| Glu or E | L-glutamic acid | |
| glu or e or D(Glu) | D-glutamic acid | |
| His or H | L-histidine | |
| Lys or K | L-lysine | |
| lys or k or (D)Lys | D-lysine | |
| hCys, hC | 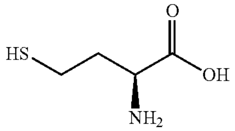 L-Homocysteine | C(CS)[C@@H](C(=O)O)N |
| KAc, Lys(Ac), K(Ac), K(COMe), or K-Ac | 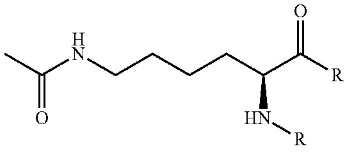 N-ε-acetyl-L-Lysine N6-Acetyl-L-lysine | CC(NCCCC[C@@H](C([R])=O)N[R])=O |
| MeK, N-MeLys, NMeLys, NMeK, or MeLys | N-methyl-Lysine (2S)-2-amino-6-(methylamino)hexanoic acid | |

TABLE 2A-continued

| Amino Acid Abbreviations | | |
|---|---|---|
| Abbreviation | Definition | Smiles |
| Pen | 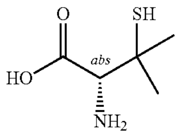 L-penicillamine, 3-Mercapto-L-valine (R)-2-Amino-3-mercapto-3-methylbutanoic acid | CC(C)([C@@H](C(O)=O)N)S |
| F4CONH2, Phe(4-$CONH_2$) or Phe(4-CONH2) or Phe(Cmd) or Phe_4Ad | 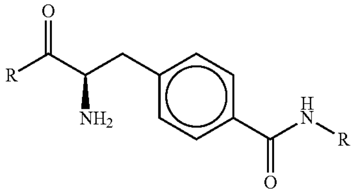 4-carbamoyl-L-phenylalanine (S)-2-amino-3-(4-carbamoylphenyl)propanoic acid | N[C@H](C([R])=O)Cc1ccc(C(N[R])=O)cc1 |
| F4OMe, Phe(4-OMe), or Phe_4OMe | 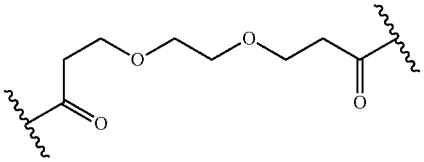 [SMILES: *C(=O)CCOCCOCCC(*)=O] 4-methoxy-L-phenylalanine | N[C@@H](CC1=CC=C(OC)C=C1)C(O)=O |
| Quin, 3Quin, 3-Quin, 3QuinolAla, or 3QuinA | 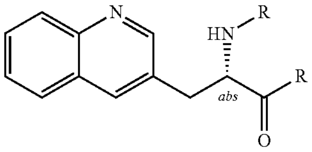 (S)-2-amino-3-(quinolin-3-yl)propanoic acid | O=C([C@H](Cc1cc2ccccc2nc1)N[R])[R] |
| R5H, | 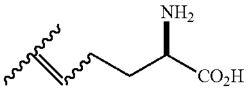 (R)-2-aminopentanoic acid 5-diyl | |
| R6H, (R,E)-2-amino-8-hydroxyoct-7-enoic acid | 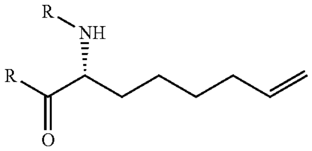 (R)-2-aminohexanoic acid 6-diyl | C=CCCCC[C@H](C([R])=O)N[R] |
| R7H, (R,E)-2-amino-9-hydroxynon-8-enoic acid | 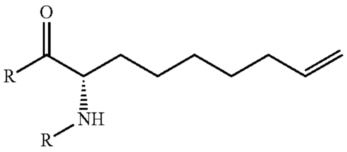 (R)-2-aminoheptanoic acid 7-diyl | C=CCCCCC[C@H](C([R])=O)N[R] |

TABLE 2A-continued

| Amino Acid Abbreviations | | |
|---|---|---|
| Abbreviation | Definition | Smiles |
| S5H | 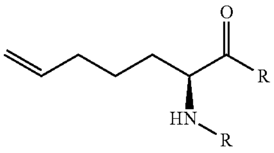<br>(S)-2-aminopentanoic acid 5-diyl | C=CCCC[C@H](N[R])C([R])=O |
| meG, Sarc, MeGly, Sar, Sarc, MeGly, Sarcosine, Methylamino-Acetic Acid, N-methylglycine | 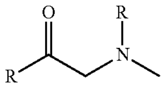<br>sarcosine or N-methylglycine | CN(CC([R])=O)[R] |
| Thr or T | L-threonine | |
| nFEtOH, Phe(4-OCH2COOH, or 2-amino-2-[4-(carboxymethoxy) phenyl]acetic acid, | Fc1c(F)c([H])c(F)c(F)c1NC[C@@H](C([R])=O)N[R]<br>(R)-2-amino-2-(4-(carboxymethoxy)phenyl)acetic acid | N[C@@H](C=O)c(cc1)ccc1OCC=O |
| DappF6 Dap(pF(6)) | 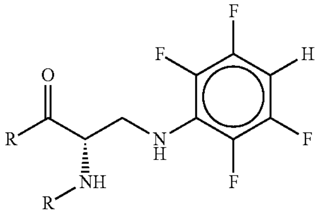<br>tetra-fluoro-phenylalanine | Fc1c(F)c([H])c(F)c(F)c1NC[C@@H](C([R])=O)N[R] |

TABLE 2B

| Abbreviations for Substituents, Reagents, and Solvents | | |
|---|---|---|
| Abbreviation | Definition | Smiles |
| Ac or MeCO | acetyl | |
| ACN | acetonitrile | |
| Boc | tert-butoxy-carbonyl | |
| $CONH_2$ | carboxamide | |
| COOH | carboxylic Acid | |
| DCM | dichloromethane | |
| Dde | N-(1-(4,4-dimethyl-2,6-dioxocyclohexylidene)ethyl | |
| DIC | N,N'-diisopropylcarbodiimide | |
| DMF | N,N-dimethylformamide | |
| $Et_2O$ | di-ethylether | |
| FMOC or Fmoc | ((9H-fluoren-9-yl)methoxy)carbonyl | |
| HOAT or HOAt | 1-hydroxy-7-azabenzotriazole | |
| MeOH | methanol | |
| MTBE | methyl tert-butyl ether | |
| MW | microwave | |
| Oxyma | ethyl cyanohydroxyiminoacetate | |

TABLE 2B-continued
| Abbreviations for Substituents, Reagents, and Solvents | | |
|---|---|---|
| Abbreviation | Definition | Smiles |
| PEG2_DiAcid or PEG2DA | 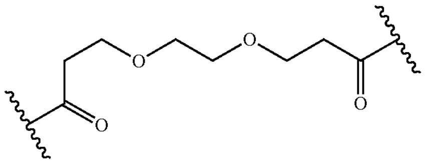 3,3'-(ethane-1,2-diylbis(oxy))dipropanecarbonyl | |
| pF | 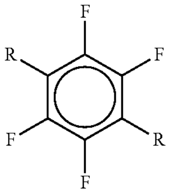 2,3,5,6-tetrafluorophen-1,4-diyl linker | Fc1c(F)c([R])c(F)c(F)c1[R] |
| pFS | 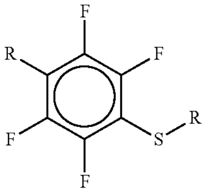 2,3,5,6-tetrafluoro-4-mercaptophenol | Fc(c(S[R])c(c(F)c1[R])F)c1F |
| RT | room temperature | |
| TFA | trifluoroacetic acid | |
| TIPS | triisopropylsilane | |

TABLE 2C
| # | Symbol/Name | Structure | Smiles |
|---|---|---|---|
| | | Monomers | |
| 1 | bMeW(2S3R)<br>bMeW(2S,3R) | 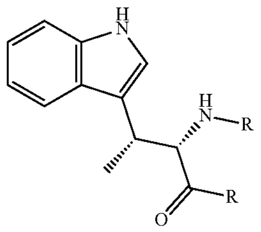 | C[C@H](C1=CNC2=C1C=CC=C2)[C@H](N[R])C([R])=O |
| 2 | bMeW(2S3S),<br>bMeW(2S,3S) | 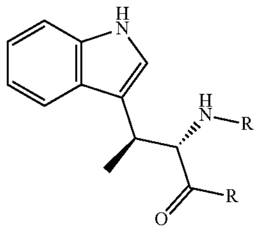<br>$C_{12}H_{12}N_2OR_2$ | C[C@@H](C1=CNC2=C1C=CC=C2)[C@H](N[R])C([R])=O |
| 3 | $6OH_2Nal$ | 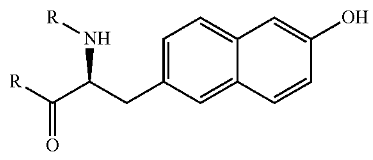<br>(*S*)-2-amino-3-(6-hydroxynaphthalen-2-yl)propanoic acid | [R]C([C@H](CC1=CC=C(C=C(O)C=C2)C2=C1)N[R])=O |

TABLE 2C-continued
| # | Symbol/Name | Monomers Structure | Smiles |
|---|---|---|---|
| 4 | NMe7MeW | 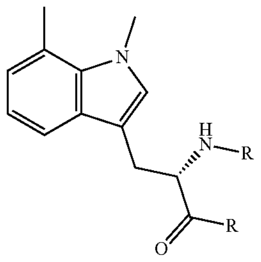 $C_{13}H_{14}N_2OR_2$ | [R]C([C@@H](N[R])CC1=CN(C)C2=C1C=CC=C2C)=O |
| 5 | 7(4Paz)W | 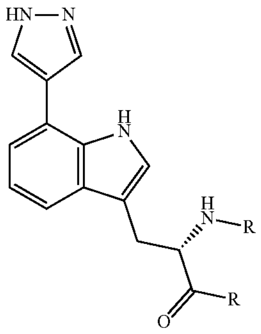 $C_{14}H_{12}N_4OR_2$ | [R]C([C@@H](N[R])CC1=CNC2=C1C=CC=C2C3=CNN=C3)=O |
| 6 | 7(7(124TAZP))W | 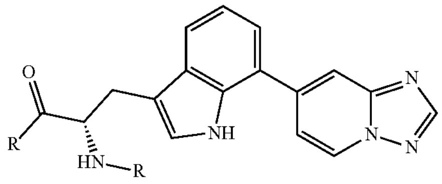 $C_{17}H_{13}N_5OR_2$ | [R]C([C@@H](N[R])CC1=CNC2=C1C=CC=C2C3=CC4=NC=NN4C=C3)=O |

TABLE 2C-continued
| Monomers | | | |
|---|---|---|---|
| # | Symbol/Name | Structure | Smiles |
| 7 | 7(3UrPh)W | 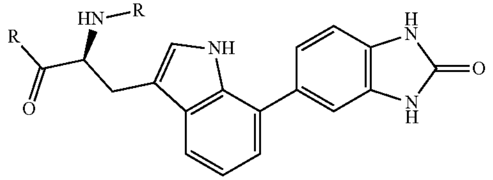<br>$C_{18}H_{14}N_4O_2R_2$ | [R]C([C@@H](N[R])CC1=CNC2=C1C=CC=C2C3=CC(NC(N4)=O)=C4C=C3)=O |
| 8 | 7(7Imzpy)W | $C_{18}H_{14}N_4OR_2$ | [R]C([C@@H](N[R])CC1=CNC2=C1C=CC=C2C3=CC4=NC=CN4C=C3)=O] |
| 9 | 7(4OMePh)W | 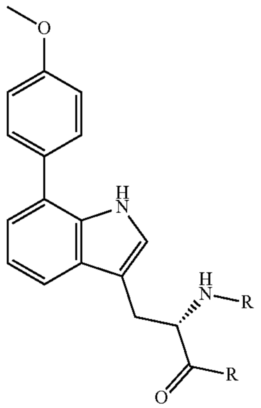<br>$C_{18}H_{16}N_2O_2R_2$ | [R]C([C@@H](N[R])CC1=CNC2=C1C=CC=C2C3=CC=C(OC)C=C3)=O |

TABLE 2C-continued
| Monomers | | | |
|---|---|---|---|
| # | Symbol/Name | Structure | Smiles |
| 10 | 7(3(6AzaInd1Me))W | 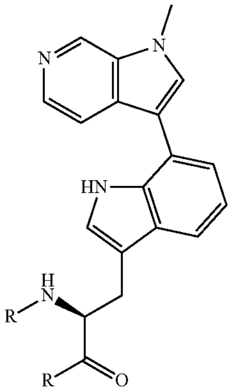 $C_{19}H_{16}N_4OR_2$ | [R]C([C@@H](N[R])CC1=CNC2=C1C=CC=C2C3=CN(C)C4=C3C=CN=C4)=O |
| 11 | 7(6(2MeNDAZ))W | 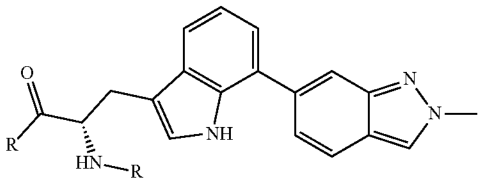 $C_{19}H_{16}N_4OR_2$ | [R]C([C@@H](N[R])CC1=CNC2=C1C=CC=C2C3=CC4=NN(C)C=C4C=C3)=O |
| 12 | NMebAla | 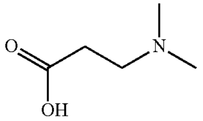 $C_5H_{11}NO$ | CN(C)CCC=O |
| 13 | AcMorp, Ethyl-morpholino | 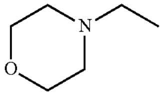 $C_5H_{11}NO$ | CN1CCOCC1 |

TABLE 2C-continued
| Monomers | | | |
|---|---|---|---|
| # | Symbol/Name | Structure | Smiles |
| 14 | dOrn, D-Orn<br>D-Ornithine | 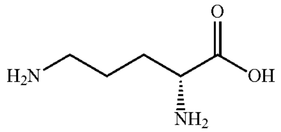<br>$C_5H_{12}N_2O$ | NCCC[C@H](C(O)=O)N |
| 15 | 3Hyp, 3-Hydroxy-L-proline | 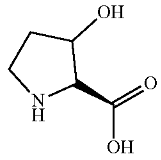<br>$C_5H_9NO_2$ | OC1[C@@H](C=O)NCC1 |
| 16 | aMeE<br>aMeGlu, alpha-methyl glutamic acid | 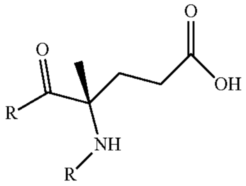<br>$C_6H_{11}NO_2$ | C[C@](CCC(O)=O)(C([R])=O)N[R]C[C@](CCC(O)=O)(C=O)N |
| 17 | hGlu, (S)-2-aminohexanedioic acid | 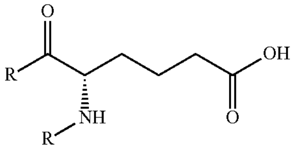<br>$C_6H_{11}NO_2$ | N[C@@H](CCCC=O)C=OOC(CCC[C@@H](C([R])=O)N[R])=O |
| 18 | CON(NMePip) | 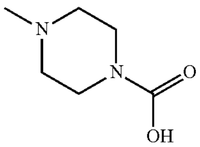<br>$C_6H_{12}N_2O$ | CN(CC1)CCN1C=O |

TABLE 2C-continued
| Monomers | | | |
|---|---|---|---|
| # | Symbol/Name | Structure | Smiles |
| 19 | -CODiFPip, CO(DiFPip) | 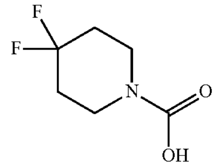 [SMILES: O=C(O)N1CCC(F)(F)CC1] $C_6H_9$F2NO | O═CN(CC1)CCC1(F)F |
| 20 | CO(OAZBO) | 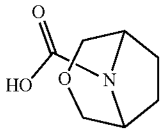 [SMILES: O=C(O)N1C2CCC1COC2] $C_8H_{13}NO_2$ | CC(N1C2COCC1CC2)═O |
| 21 | Me1Pya, (S)-3-(2-amino-2-carboxyethyl)-1-methylpyridin-1-ium | 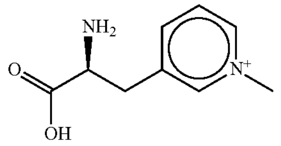 $C_9H_{13}N_2O^+$ | C[n+]1cccc(C[C@@H](C═O)N)c1 |
| 22 | DappF6, tetra-fluoro-phenylalanine | 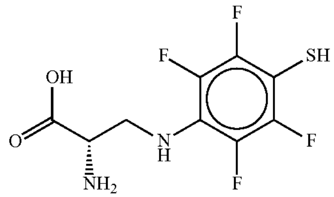 $C_9H_8$F4$N_2$O | N[C@@H](CNc(c(F)c(c(S)c1F)F)c1F)C═O |
| 23 | bMePhe(2S,3R) bMePhe(SR), bMePhe(2S,3R) | 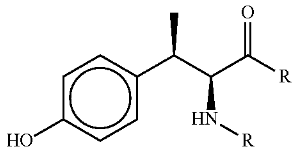 $C_{10}H_{11}NOR_2$ | C[C@@H]([C@@H](C([R])═O)N[R])c1ccccc1 |

TABLE 2C-continued

| Monomers | | | |
|---|---|---|---|
| # | Symbol/Name | Structure | Smiles |
| 24 | $N_4$AmBenzylGly, N(4AmBenzyl)Gly | 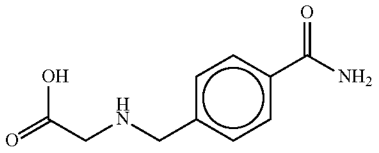 $C_{10}H_{12}N_2O_2$ | NC(c1ccc(CNCC=O)cc1)=O |
| 25 | -Dec, 1,10-Decanedioic Acid | 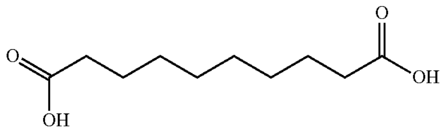 [SMILES: O=C(O)CCCCCCCCC(=O)O] $C_{10}H_{18}O_3$ | OC(CCCCCCCCC=O)=O |
| 26 | $2OH_3$Pyrimid5Ala | 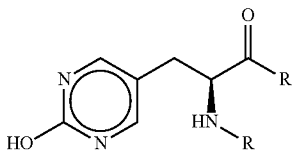 $C_{11}H_{15}N_3O_2R_2$ | CC(C)(C)Oc1ncc(C[C@@H](C([R])=O)N[R])cn1 |
| 27 | KacMorph, K(AcMorph), KAcMorph, L-Lysine(ac-Morpholino | 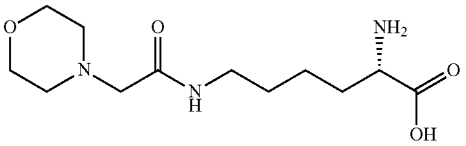 [SMILES: N[C@@H](CCCCNC(=O)CN1CCOCC1)C(=O)O] $C_{12}H_{23}N_3O_3$ | N[C@@H](CCCCNC(CN1CCOCC1)=O)C=O |
| 28 | $6OH_2$Na1 | 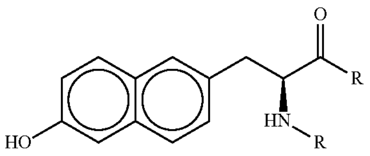 $C_{13}H_{13}NO$ | N[C@@H](Cc1cc2ccccc2cc1)C=ON[C@@H](Cc1cc2ccccc2cc1)C=OOc1ccc(cc(C[C@@H](C([R])=O)N[R])cc2)c2c1 |

TABLE 2C-continued

| # | Symbol/Name | Structure | Smiles |
|---|---|---|---|
| | Monomers | | |
| 29 | DabNMecarn, Dab(NMecarn) | 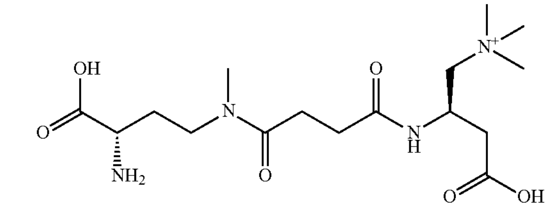 [SMILES: CN(CC[C@H](N)C(=O)O)C(=O)CCC(=O)N[C@H](CC(=O)O)C[N+](C)(C)C] $C_{16}H_{31}N_4O_4^+$ | CN(CC[C@@H](C=O)N)C(CCC(N[C@H](CC=O)C[N+](C)(C)C)=O)=OCN(CC[C@@H](C=O)N)C(CCC(N[C@H](CC=O)C[N+](C)(C)C)=O)=OCN(CC[C@@H](C=O)N)C(CCC(N[C@H](CC(O)=O)C[N+](C)(C)C)=O)=O |
| 30 | DabNMeCarn, Dab(NMeCarn) | 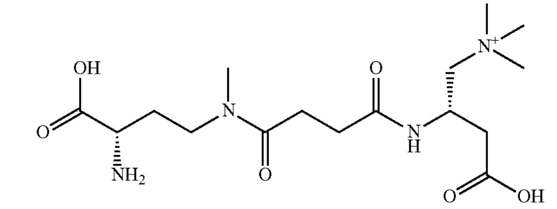 [SMILES: CN(CC[C@H](N)C(=O)O)C(=O)CCC(=O)N[C@@H](CC(=O)O)C[N+](C)(C)C] $C_{16}H_{31}N_4O_5^+$ | CN(CC[C@@H](C=O)N)C(CCC(N[C@@H](CC(O)=O)C[N+](C)(C)C)=O)=O |
| 31 | F(4TzlTMA4) | 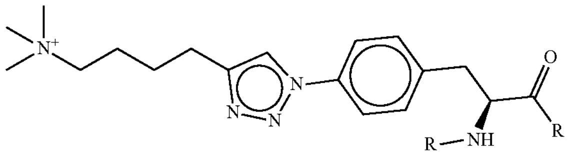 $C_{18}H_{26}N_5OR_2^+$ | C[N+](C)(C)CCCCc1cn(-c2ccc(C[C@@H](C([R])=O)N[R])cc2)nn1 |
| 32 | NMeK(d), NMeKdCar | 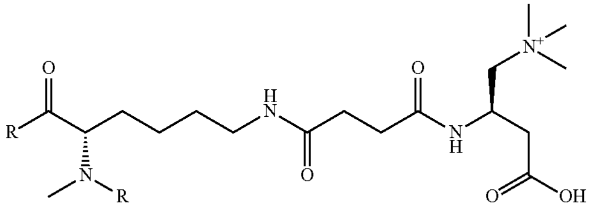 $C_{18}H_{33}N_4O_5R_2^+$ | CN([C@@H](CCCCNC(CCC(N[C@H](CC(O)=O)C[N+](C)(C)C)=O)=O)C([R])=O)[R] |

TABLE 2C-continued
| Monomers | | | |
|---|---|---|---|
| # | Symbol/Name | Structure | Smiles |
| 33 | 7(5(Ina7Pyr))W | 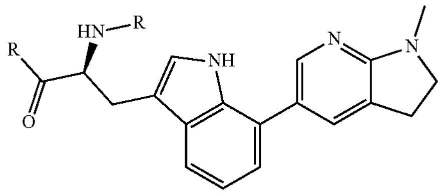 $C_{19}H_{18}N_4OR_2$ | [R]C([C@@H](N[R])CC1=CNC2=C1C=CC=C2C3=CN=C(N(C)CC4)C4=C3)=O |
| 34 | F(4TzlTMA5) | 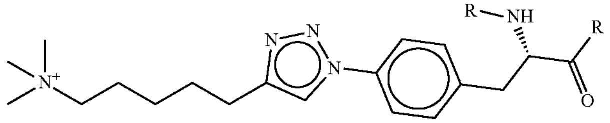 $C_{19}H_{28}N_5OR_2{}^+$ | C[N+](C)(C)CCCCCc1cn(-c2ccc(C[C@@H](C([R])=O)N[R])cc2)nn1 |
| 35 | CF3CO F3CO | 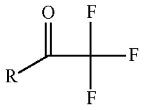 $C_2$F3OR | O=C(C(F)(F)F)[R] |
| 36 | CF3Propylamide | 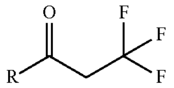 $C_3H_2$F3OR | O=C(CC(F)(F)F)[R] |
| 37 | C(1*) (*pure but configuration unknown) | 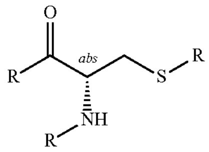 $C_3H_4NOSR_3$ | O=C([C@H](CS[R])N[R])[R] |
| 38 | bAla, b-ALA, beta-Alanine, bA | 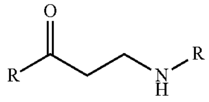 $C_3H_5NOR_2$ | O=C(CCN[R])[R] |

TABLE 2C-continued
| Monomers | | | |
|---|---|---|---|
| # | Symbol/Name | Structure | Smiles |
| 39 | CON(Me)2 | 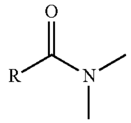 $C_3H_6NOR$ | CN(C)C([R])═O |
| 40 | D(2) | 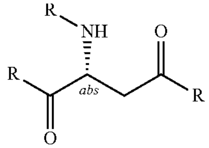 $C_4H_4NO_2R_3$ | O═C(C[C@@H](C([R])═O)N[R])[R] |
| 41 | cPrCO | 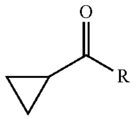 $C_4H_5OR$ | O═C(C1CC1)[R] |
| 42 | hS, hS, , Hse, L-homoserine, homoS, or homoSer | 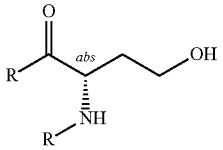 $C_4H_7NO_2R_2$ | OCC[C@@H](C([R])═O)N[R] |
| 43 | T, dThr, dT | 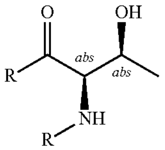 $C_4H_7NO_2R_2$ | C[C@H]([C@H](C([R])═O)N[R])O |
| 44 | 4sb, 4SB | 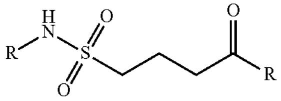 $C_4H_7NO_3SR_2$ | O═C([R])CCCS(═O)(N[R])═O |

TABLE 2C-continued
| Monomers | | | |
|---|---|---|---|
| # | Symbol/Name | Structure | Smiles |
| 45 | Aib, AIB, 2-Aminoisobutyric acid, Alpha-aminoisobutyric acid, (2-aminoalanine) | 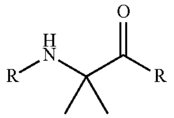 $C_4H_7NOR_2$ | CC(C)(C([R])=O)N[R] |
| 46 | | | |
| 47 | NMebAla | 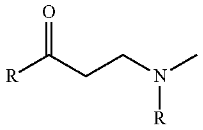 $C_4H_7NOR_2$ | CN(CCC([R])=O)[R] |
| 48 | aMeC | 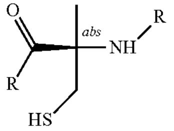 $C_4H_7NOSR_2$ | C[C@](CS)(C([R])=O)N[R]C[C@](CS)(C=O)N |
| 49 | hC, hCys, homoC, or homoCys | 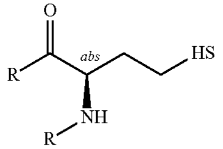 $C_4H_7NOSR_2$ | O=C([C@H](CCS)N[R])[R] |
| 50 | iPrCO | 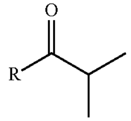 $C_4H_7OR$ | CC(C)C([R])=O |

TABLE 2C-continued
| Monomers | | | |
|---|---|---|---|
| # | Symbol/Name | Structure | Smiles |
| 51 | dDab, dab, (R)-2,4-diaminobutanoic acid | 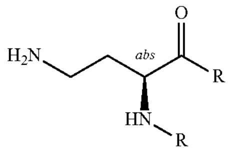 $C_4H_8N_2OR_2$ | NCC[C@H](C([R])=O)N[R] |
| 52 | homobAla | 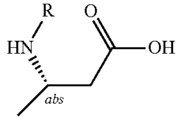 $C_4H_8NO_2R$ | C[C@@H](CC(O)=O)N[R] |
| 53 | Bua, Butanoic acid | 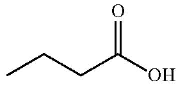 $C_4H_8O_2$ | CCCC(O)=O |
| 54 | Orn, ORN, Ornithine | 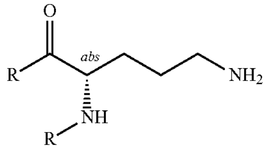 $C_5H_{10}N_2OR_2$ | NCCC[C@@H](C([R])=O)N[R] |
| 55 | | | |
| 56 | Orn, L-ornithine | 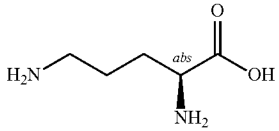 $C_5H_{12}N_2O_2$ | NCCC[C@@H](C(O)=O)N |
| 57 | 4diFPro | 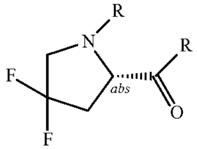 $C_5H_5F2NOR_2$ | O=C([C@H](CC(C1)(F)F)N1[R])[R]O=C[C@H](C1)NCC1(F)F |

TABLE 2C-continued
| Monomers | | | |
|---|---|---|---|
| # | Symbol/Name | Structure | Smiles |
| 58 | prG, prG, Fmoc-L-propargyl-Gly-OH, Pra | 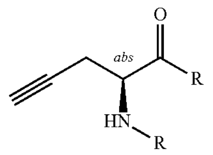 $C_5H_5NOR_2$ | C#CC[C@@H](C([R])=O)N[R] |
| 59 | 4TriazolAla | 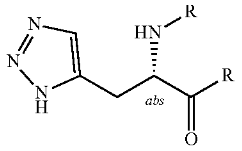 $C_5H_6N_4OR_2$ | O=C([C@H](Cc1cnn[nH]1)N[R])[R] |
| 60 | Tzl | 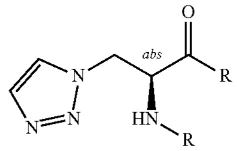 $C_5H_6N_4OR_2$ | O=C([C@H](Cn1nncc1)N[R])[R] |
| 61 | PyE, PyE (S)-5-oxopyrrolidine-2-carboxylic acid | 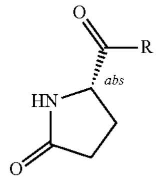 $C_5H_6NO_2R$ | O=C([C@H](CC1)NC1=O)[R]O=C[C@H](CC1)NC1=O |
| 62 | E(2) | 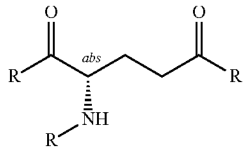 $C_5H_6NO_2R_3$ | O=C(CC[C@@H](C([R])=O)N[R])[R] |

TABLE 2C-continued
| Monomers | | | |
|---|---|---|---|
| # | Symbol/Name | Structure | Smiles |
| 63 | Tetrazole | 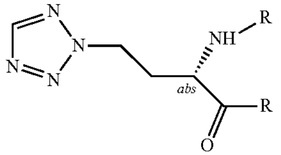 $C_5H_7N_5OR_2$ | O=C([C@H](CCn1nncn1)N[R])[R]N[C@@H](CCn1nncn1)C=O |
| 64 | 3OHPro | 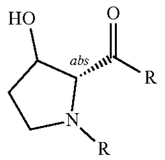 $C_5H_7NO_2R_2$ | OC(CC1)[C@@H](C([R])=O)N1[R] |
| 65 | 4(R)HydroxyPro | 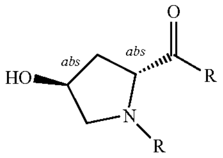 $C_5H_7NO_2R_2$ | O[C@H](C[C@H]1C([R])=O)CN1[R] |
| 66 | Hyp | 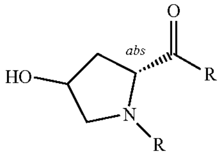 $C_5H_7NO_2R_2$ | OC(C[C@H]1C([R])=O)CN1[R] |
| 67 | AllylGly | 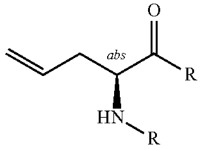 $C_5H_7NOR_2$ | C=CC[C@@H](C([R])=O)N[R] |

TABLE 2C-continued
| Monomers | | | |
|---|---|---|---|
| # | Symbol/Name | Structure | Smiles |
| 68 | Dap(Ac) | 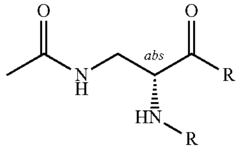 $C_5H_8N_2O_2R_2$ | CC(NC[C@@H](C([R])=O)N[R])=O |
| 69 | N(NMe), NNMe, NMeAsn | 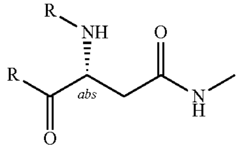 $C_5H_8N_2O_2R_2$ | CNC(C[C@@H](C([R])=O)N[R])=O |
| 70 | aMeN. aMeAsn | 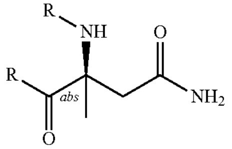 $C_5H_8N_2O_2R_2$ | C[C@](CC(N)=O)(C([R])=O)N[R] |
| 71 | 4(S)AminoPro | 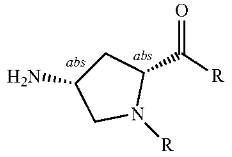 $C_5H_8N_2OR_2$ | N[C@@H](C[C@H]1C([R])=O)CN1[R] |
| 72 | CO(Morph) | 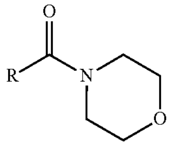 $C_5H_8NO_2R$ | O=C(N1CCOCC1)[R] |

TABLE 2C-continued
| # | Symbol/Name | Structure | Smiles |
|---|---|---|---|
| | | Monomers | |
| 73 | -COMorph, CO(Morph) | 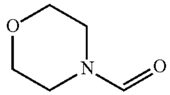 $C_5H_9NO_2$ | O═CN1CCOCC1 |
| 74 | | | |
| 75 | Nva | 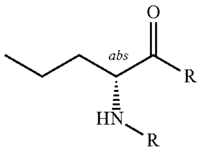 $C_5H_9NOR_2$ | CCC[C@@H](C([R])═O)N[R] |
| 76 | dM, dMet, D-Methionine | 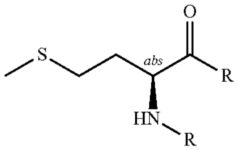 $C_5H_9NOSR_2$ | CSCC[C@H](C([R])═O)N[R] |
| 77 | dPen, pen | 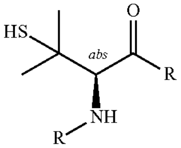 $C_5H_9NOSR_2$ | CC(C)([C@H](C([R])═O)N[R])S |
| 78 | BuCO | 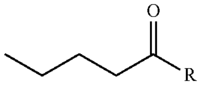 $C_5H_9OR$ | CCCCC([R])═O |
| 79 | iBuCO | 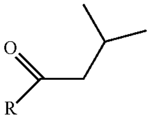 $C_5H_9OR$ | CC(C)CC([R])═OCC[C@H](C)C([R])═O |

TABLE 2C-continued
| | | | |
|---|---|---|---|
| Monomers | | | |
| # | Symbol/Name | Structure | Smiles |
| 80 | tBuCO | 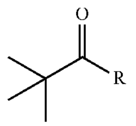<br>$C_5H_9OR$ | CC(C)(C)C([R])=O |
| 81 | N(N(Me)2), NNMe2 | 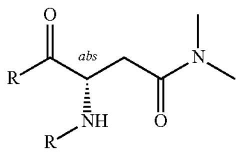<br>$C_6H_{10}N_2O_2R_2$ | CN(C)C(C[C@@H](C([R])=O)N[R])=O |
| 82 | MorphCO, 2-morpholinoacetic acid | 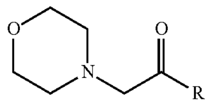<br>$C_6H_{10}NO_2R$ | O=C(CN1CCOCC1)[R] |
| 83 | CON(NMePip) | 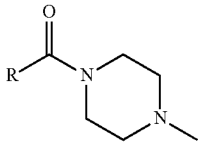<br>$C_6H_{11}N_2OR$ | CN(CC1)CCN1C([R])=O |
| 84 | eK | 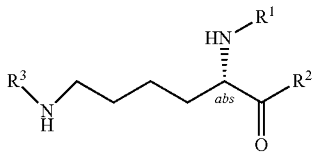<br>$C_6H_{11}N_2OR_3$ | O=C(O)[C@@H](N[R])CCCCN[R] |

TABLE 2C-continued
| Monomers | | | |
|---|---|---|---|
| # | Symbol/Name | Structure | Smiles |
| 85 | Cit, Citrulline | 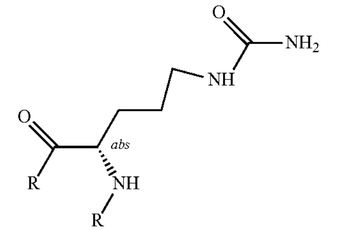 $C_6H_{11}N_3O_2R_2$ | NC(NCCC[C@@H](C([R])=O)N[R])=ON[C@@H](CCCNC(N)=O)C(O)=O |
| 86 | D(NEtNH$_2$) | 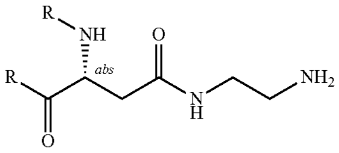 $C_6H_{11}N_3O_2R_2$ | NCCNC(C[C@@H](C([R])=O)N[R])=O |
| 87 | Aad, 2-Aminoadipic acid | 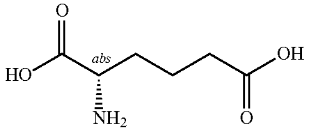 $C_6H_{11}NO_4$ | N[C@@H](CCCC(O)=O)C(O)=O |
| 88 | N(Isobutyl)Gly | 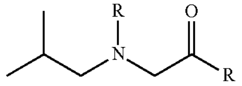 $C_6H_{11}NOR_2$ | CC(C)CN(CC([R])=O)[R] |
| 89 | PentCO | 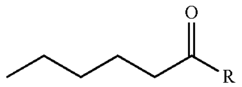 $C_6H_{11}OR$ | CCCCCC([R])=O |
| 90 | NMeQ, NMeGln, N-Methyl-Glutamine | 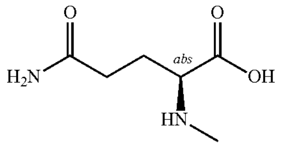 $C_6H_{12}N_2O_3$ | CN[C@@H](CCC(N)=O)C(O)=O |

TABLE 2C-continued
| Monomers | | | |
|---|---|---|---|
| # | Symbol/Name | Structure | Smiles |
| 91 | SP6 | 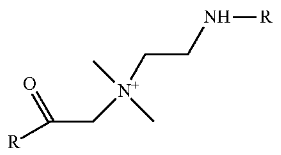 $C_6H_{13}N_2OR_2^+$ | C[N+](C)(CCN[R])CC([R])=OC[N+](C)(CCN)CC=O |
| 92 | 3IOxa4Ala | 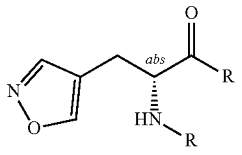 $C_6H_6N_2O_2R_2$ | O=C([C@H](Cc1conc1)N[R])[R] |
| 93 | 3Oxa4Ala | 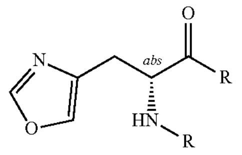 $C_6H_6N_2O_2R_2$ | O=C([C@H](Cc1cocn1)N[R])[R] |
| 94 | diFCpx | 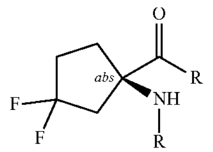 $C_6H_7$F2NO$R_2$ | O=C([C@](CC1)(CC1(F)F)N[R])[R] |
| 95 | aMePra | 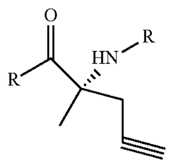 $C_6H_7NOR_2$ | C[C@](CC#C)(C([R])=O)N[R] |

TABLE 2C-continued
| Monomers | | | |
|---|---|---|---|
| # | Symbol/Name | Structure | Smiles |
| 96 | CO(DiFPip) | 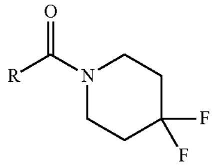<br>$C_6H_8F2NOR$ | O=C(N(CC1)CCC1(F)F)[R] |
| 97 | dab(COCH$_2$(1*))<br>dab(COCH$_2$)(1*) | 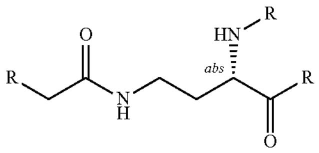<br>$C_6H_9N_2O_2R_3$ | O=C(C[R])NCC[C@@H](C([R])=O)N[R] |
| 98 | Tetrazole(NMe) | 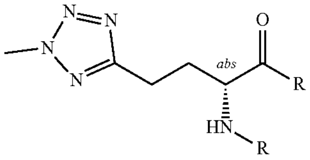<br>$C_6H_9N_5OR_2$ | Cn1nnc(CC[C@@H](C([R])=O)N[R])n1 |
| 99 | | | |
| 100 | dhE | 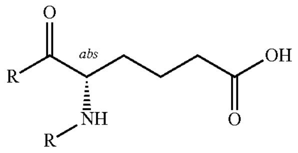<br>$C_6H_9NO_3R_2$ | OC(CCC[C@H](C([R])=O)N[R]=O |
| 101 | Acpx | 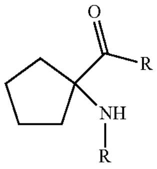<br>$C_6H_9NOR_2$ | O=C(C1(CCCC1)N[R])[R]NC1(CCCC1)C=O |

TABLE 2C-continued
| Monomers | | | |
|---|---|---|---|
| # | Symbol/Name | Structure | Smiles |
| 102 | aMeP, aMePro | 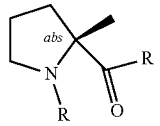 $C_6H_9NOR_2$ | C[C@](CCC1)(C([R])═O)N1[R] |
| 103 | $D(N_2AmIm)$ | 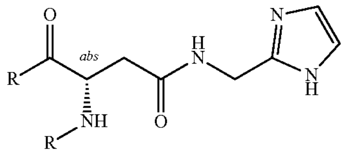 $C_8H_{10}N_4O_2R_2$ | O═C(C[C@@H](C([R])═O)N[R])NCc1ncc[nH]1 |
| 104 | KTfa, K(Tfa), L-Lys(Tfa) | 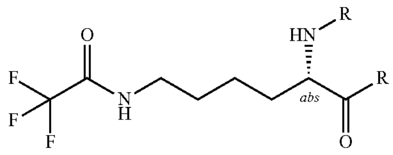 $C_8H_{11}F3N_2O_2R_2$ | O═C([C@H](CCCCNC(C(F)(F)F)═O)N[R])[R] |
| 105 | E(OAll) | 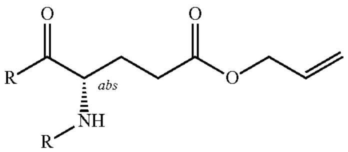 $C_8H_{11}NO_3R_2$ | C═CCOC(CC[C@@H](C([R])═O)N[R])═O |
| 106 | D(NPyr) | 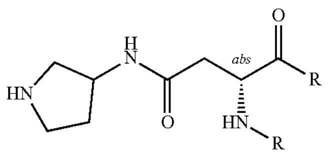 $C_8H_{13}N_3O_2R_2$ | O═C(C[C@@H](C([R])═O)N[R])NC1CNCC1 |

TABLE 2C-continued
| # | Symbol/Name | Structure | Smiles |
|---|---|---|---|
| | Monomers | | |
| 107 | Chg | 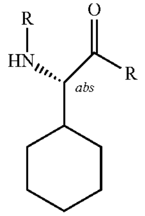 $C_8H_{13}NOR_2$ | O═C([C@H](C1CCCCC1)N[R])[R] |
| 108 | R5Me, aMeR5H | 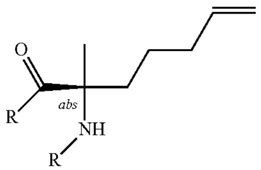 $C_8H_{13}NOR_2$ | C[C@@](CCCC═C)(C([R])═O)N[R] |
| 109 | R6H, (R,E)-2-amino-8-hydroxyoct-7-enoic acid | 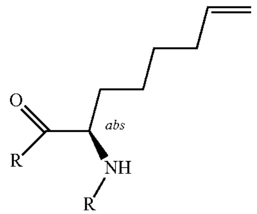 $C_8H_{13}NOR_2$ | C═CCCCC[C@H](C([R])═O)N[R]C═CCCCC[C@H](C═O)N |
| 110 | S5Me aMeS5H | 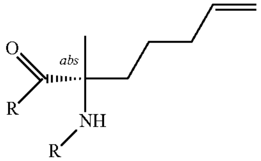 $C_8H_{13}NOR_2$ | C[C@](CCCC═C)(C([R])═O)N[R] |

TABLE 2C-continued
| Monomers | | |
|---|---|---|
| # Symbol/Name | Structure | Smiles |
| 111 S6H | 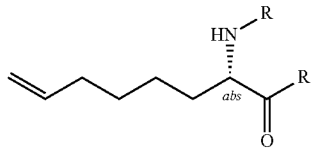 $C_8H_{13}NOR_2$ | C=CCCCC[C@@H](C([R])=O)N[R] |
| 112 KAc, K(Ac), K(COMe), K-Ac, N6-acetyl-L-Lysine | 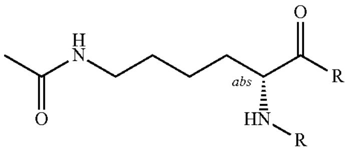 $C_8H_{14}N_2O_2R_2$ | CC(NCCCC[C@@H](C([R])=O)N[R])=O |
| 113 Pip(NMe2) | 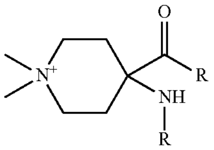 $C_8H_{15}N_2OR_2^+$ | C[N+](C)(CC1)CCC1(C([R])=O)N[R] |
| 114 K(Gly) | 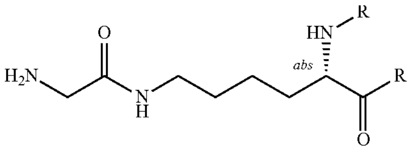 $C_8H_{15}N_3O_2R_2$ | NCC(NCCCC[C@@H](C([R])=O)N[R])=O |
| 115 8Aoc, 8Aoc(2) | 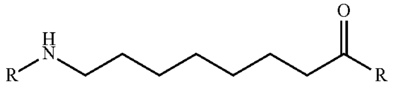 $C_8H_{15}NOR_2$ | O=C(CCCCCCCN[R])[R] |
| 116 2Benzyl | 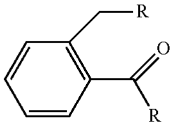 $C_8H_6OR_2$ | O=C(c1c(C[R])cccc1)[R] |

TABLE 2C-continued

| Monomers | | | |
|---|---|---|---|
| # | Symbol/Name | Structure | Smiles |
| 117 | $6OH_3Pya$ | 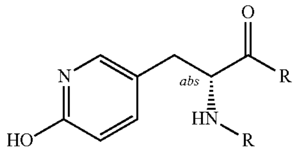 $C_8H_8N_2O_2R_2$ | Oc1ncc(C[C@@H](C([R])=O)N[R])cc1 |
| 118 | 3Pya, 3Pal, 3-(2-pyridyl)-alanine | 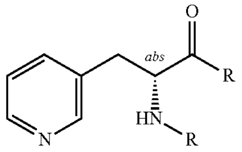 $C_8H_8N_2OR_2$ | O=C([C@H](Cc1cnccc1)N[R])[R] |
| 119 | 4Pya, 4Pya, 4Pal, (S)-2-amino-3-(pyridin-4-yl)propanoic acid 4PyridinAla | 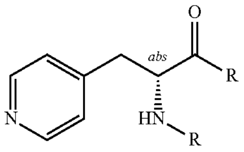 $C_8H_8N_2OR_2$ | O=C([C@H](Cc1ccncc1)N[R])[R] |
| 120 | dPal, dpal, d3Pya, 3pya, 3-pyridylalanine, (R)-2-amino-3-(pyridin-3-yl)propanoic acid | 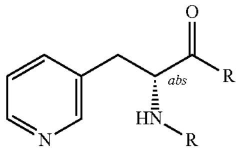 $C_8H_8N_2OR_2$ | O=C([C@@H](Cc1cnccc1)N[R])[R] |
| 121 | 6MePyridazAla | 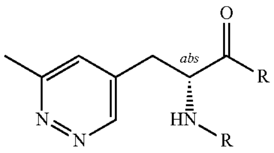 $C_8H_9N_3OR_2$ | Cc1cc(C[C@@H](C([R])=O)N[R])cnn1 |

TABLE 2C-continued
| # | Symbol/Name | Structure | Smiles |
|---|---|---|---|
| | | Monomers | |
| 122 | 5MePyridinAla | 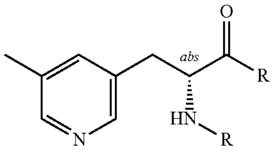 $C_9H_{10}N_2OR_2$ | Cc1cc(C[C@@H](C([R])=O)N[R])cnc1 |
| 123 | J, Aph, 4-aminophenylalanine | 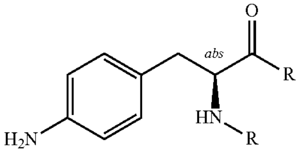 $C_9H_{10}N_2OR_2$ | Nc1ccc(C[C@@H](C([R])=O)N[R])cc1 |
| 124 | NMe3Pya | 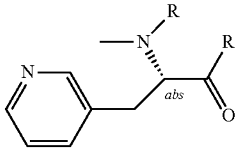 $C_9H_{10}N_2OR_2$ | CN([C@@H](Cc1cnccc1)C([R])=O)[R]CN[C@@H](Cc1cnccc1)C=O |
| 125 | SMSBCO | 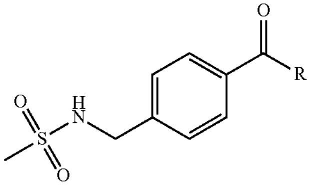 $C_9H_{10}NO_3SR$ | CS(NCc(cc1)ccc1C([R])=O)(=O)=O |
| 126 | Me3Pya | 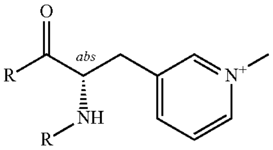 $C_9H_{11}N_2OR_2^+$ | C[n+]1cccc(C[C@@H](C([R])=O)N[R])c1 |

TABLE 2C-continued
| # | Symbol/Name | Structure | Smiles |
|---|---|---|---|
| | | Monomers | |
| 127 | D(Pip), (S)-2-amino-4-oxo-4-(piperidin-1-yl)butanoic acid | 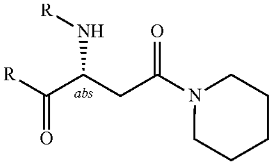<br>$C_9H_{14}N_2O_2R_2$ | O=C(C[C@@H](C([R])=O)N[R])N1CCCCC1 |
| 128 | D(NPip) | 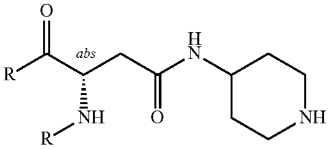<br>$C_9H_{15}N_3O_2R_2$ | O=C(C[C@@H](C([R])=O)N[R])NC1CCNCC1 |
| 129 | N(Cyclohexyl)Gly | 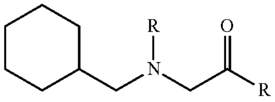<br>$C_9H_{15}NOR_2$ | O=C(CN(CC1CCCCC1)[R])[R] |
| 130 | R7H, (R,E)-2-amino-9-hydroxynon-8-enoic acid | 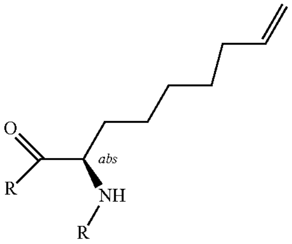<br>$C_9H_{15}NOR_2$ | C=CCCCCC[C@H](C([R])=O)N[R]C=CCCCCC[C@H](C=O)N |
| 131 | K(COEt) | 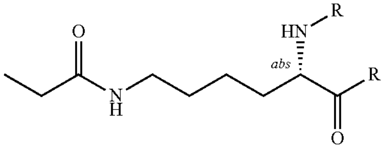<br>$C_9H_{16}N_2O_2R_2$ | CCC(NCCCC[C@@H](C([R])=O)N[R])=O |

TABLE 2C-continued
| Monomers | | | |
|---|---|---|---|
| # | Symbol/Name | Structure | Smiles |
| 132 | K(NMeAc), KNMeAc | 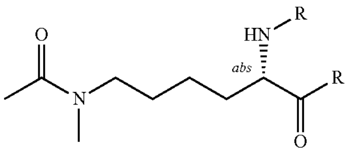 $C_9H_{16}N_2OR_2$ | CC(N(C)CCCC[C@@H](C([R])=O)N[R])=O |
| 133 | Q(NHtBu) | 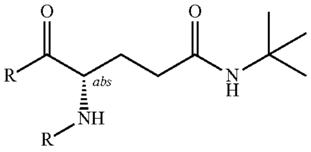 $C_9H_{16}N_2O_2R_2$ | CC(C)(C)NC(CC[C@@H](C([R])=O)N[R])=O |
| 134 | K(Me)3 | 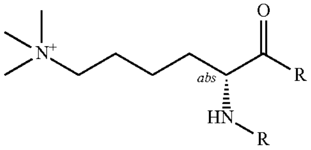 $C_9H_{19}N_2OR_2^+$ | C[N+](C)(C)CCCC[C@@H](C([R])=O)N[R] |
| 135 | dK(Me)3, k(Me)3 | 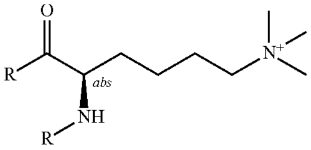 $C_9H_{19}N_2OR_2^+$ | C[N+](C)(C)CCCC[C@H](C([R])=O)N[R] |
| 136 | 5cpaCO | 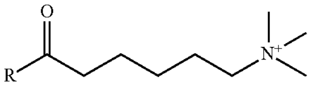 $C_9H_{19}NOR^+$ | C[N+](C)(C)CCCCCC([R])=O |

TABLE 2C-continued
| Monomers | | |
|---|---|---|
| # Symbol/Name | Structure | Smiles |
| 137 tetraFPhe | 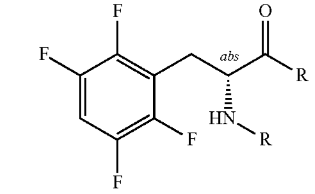 $C_9H_5F4NOR_2$ | O=C([C@H](Cc(c(F)c(cc1F)F)c1F)N[R])[R] |
| 138 5CF33Pya | 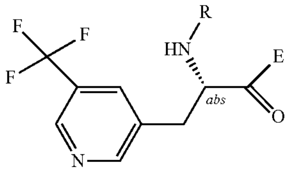 $C_9H_7F3N_2OR_2$ | O=C([C@H](Cc1cncc(C(F)(F)F)c1)N[R])[R]N[C@@H](Cc1cc(C(F)(F)F)cnc1)C=O |
| 139 3,4diFPhe, 4diFPhe | 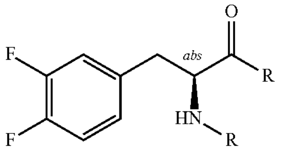 $C_9H_7F2NOR_2$ | O=C([C@H](Cc(cc1)cc(F)c1F)N[R])[R] |
| 140 F(4$N_3$) | 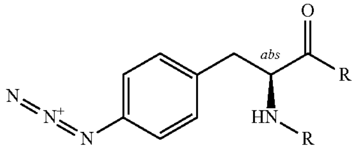 $C_9H_8N_4OR_2$ | [N-]=[N+]=Nc1ccc(C[C@@H](C([R])=O)N[R])cc1 |
| 141 3FTyr | 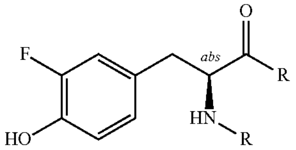 $C_9H_8FNO_2R_2$ | Oc(ccc(C[C@@H](C([R])=O)N[R])c1)c1F |

TABLE 2C-continued
| # | Symbol/Name | Structure | Smiles |
|---|---|---|---|
| | Monomers | | |
| 142 | 2BrPhe, 2BrF | 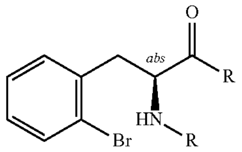 $C_9H_8NrNOR_2$ | O═C([C@H](Cc(cccc1)c1Br)N[R])[R] |
| 143 | 2FPHE, 2FPhe | 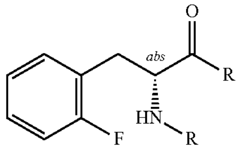 $C_9H_8FNOR_2$ | O═C([C@H](Cc(cccc1)c1F)N[R])[R] |
| 144 | 3FPHE, 3FPhe | 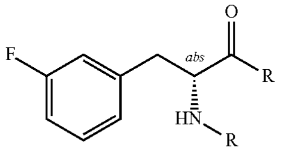 $C_9H_8FNOR_2$ | O═C([C@H](Cc1cc(F)ccc1)N[R])[R] |
| 145 | BHCO | 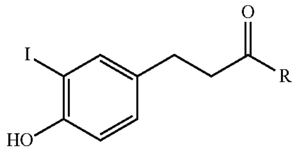 $C_9H_8IO_2R$ | Oc(ccc(CCC([R])═O)c1)c1I |
| 146 | 5AmPyridinAla | 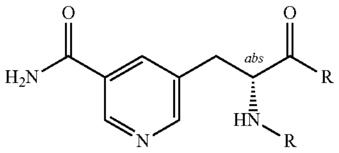 $C_9H_9N_3O_2R_2$ | NC(c1cc(C[C@@H](C([R])═O)N[R])cnc1)═O |

TABLE 2C-continued
| Monomers | | |
|---|---|---|
| # Symbol/Name | Structure | Smiles |
| 147 mTYR, mY, mTyr | 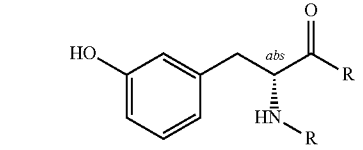 $C_9H_9NO_2R_2$ | Oc1cccc(C[C@@H](C([R])=O)N[R])c1 |
| 148 6OHQuin | 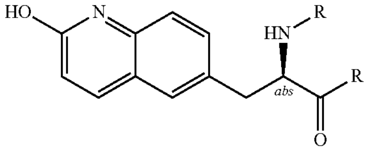 $C_{12}H_{10}N_2O_2R_2$ | Oc1ccc(cc(C[C@@H](C([R])=O)N[R])cc2)c2n1 |
| 149 4AmF, 4AmPhe | 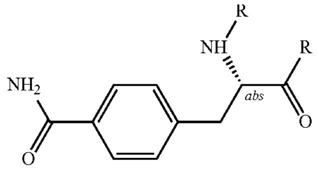 $C_{10}H_{10}N_2O_2R_2$ | NC(c1ccc(C[C@@H](C([R])=O)N[R])cc1)=ON[C@@H](Cc(cc1)ccc1C(N)=O)C=O |
| 150 AEF(NMe(2)) | 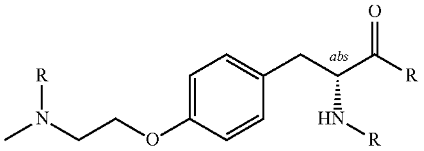 $C_{12}H_{15}N_2O_2R_3$ | CN(CCOc1ccc(C[C@@H](C([R])=O)N[R])cc1)[R] |
| 151 aMeY01 | 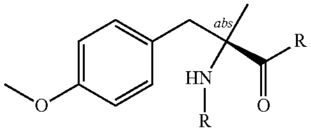 $C_{11}H_{13}NO_2R_2$ | C[C@](Cc(cc1)ccc1OC)(C([R])=O)N[R] |

TABLE 2C-continued
| Monomers | | |
|---|---|---|
| # Symbol/Name | Structure | Smiles |
| 152 BiF | 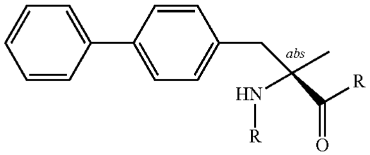 $C_{16}H_{15}NOR_2$ | C[C@](Cc(cc1)ccc1-c1ccccc1)(C([R])=O)N[R] |
| 153 hdKMe3, hk(Me)3 | 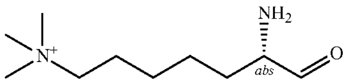 $C_{10}H_{23}N_2O^+$ | C[N+](C)(C)CCCCC[C@H](C=O)N |
| 154 Y(OTzl) | 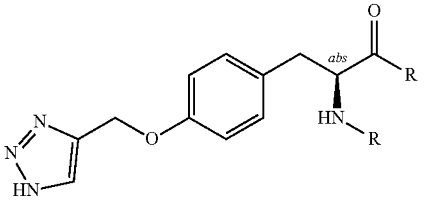 $C_{12}H_{12}N_4O_2R_2$ | O=C([C@H](Cc(cc1)ccc1OCc1c[nH]nn1)N[R])[R] |
| 155 3CONH$_2$F | 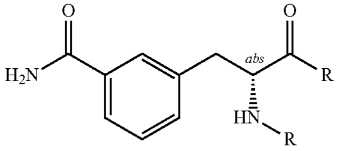 $C_{10}H_{10}N_2O_2R_2$ | NC(c1cccc(C[C@@H](C([R])=O)N[R1)c1)=O |
| 156 4AmDF, 4AmDPhe | 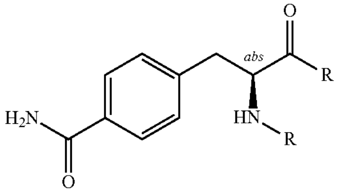 $C_{10}H_{10}N_2O_2R_2$ | NC(c1ccc(C[C@H(C([R])=O)N[R])cc1)=O |

TABLE 2C-continued
| Monomers | | | |
|---|---|---|---|
| # | Symbol/Name | Structure | Smiles |
| 157 | 4AmF, 4AmPhe | 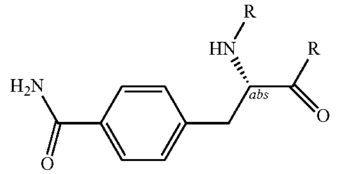 $C_{10}H_{10}N_2O_2R_2$ | NC(c1ccc(C[C@@H](C([R])=O)N[R])cc1)=ON[C@@H](Cc(cc1)ccc1C(N)=O)C=O |
| 158 | D(NPh) | 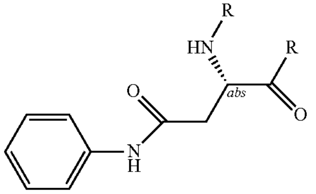 $C_{10}H_{10}N_2O_2R_2$ | O=C(C[C@@H](C([R])=O)N[R])Nc1ccccc1 |
| 159 | N(3AmBenzyl)Gly | 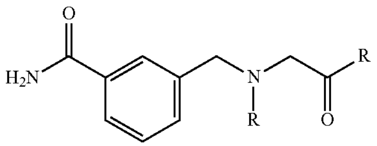 $C_{10}H_{10}N_2O_2R_2$ | NC(c1cccc(CN(CC([R])=O)[R])c1)=O |
| 160 | N(4AmBenzyl)Gly | 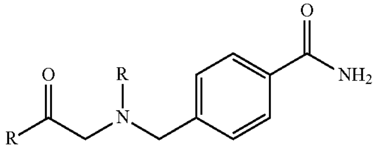 $C_{10}H_{10}N_2O_2R_2$ | NC(c1ccc(CN(CC([R])=O)[R])cc1)=O |
| 161 | 2AmTyr | 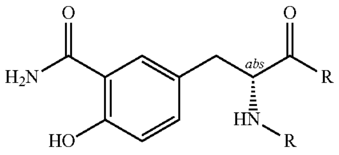 $C_{10}H_{10}N_2O_3R_2$ | NC(c(cc(C[C@@H](C([R])=O)N[R])cc1)c1O)=O |

TABLE 2C-continued
| Monomers | | |
|---|---|---|
| # Symbol/Name | Structure | Smiles |
| 162 aMeFPhe | 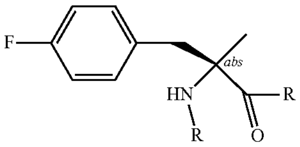 $C_{10}H_{10}FNOR_2$ | C[C@](Cc(cc1)ccc1F)(C([R])=O)N[R] |
| 163 D(NmAn) | 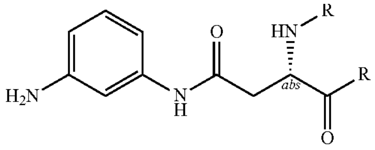 $C_{10}H_{11}N_3O_2R_2$ | Nc1cccc(NC(C[C@@H](C([R])=O)N[R])=O)c1 |
| 164 D(NoAn) | 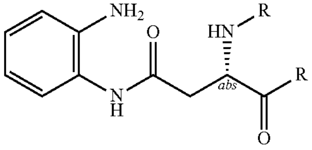 $C_{10}H_{11}N_3O_2R_2$ | Nc(cccc1)c1NC(C[C@@H](C([R])=O)N[R])=O |
| 165 D(NpAn) | 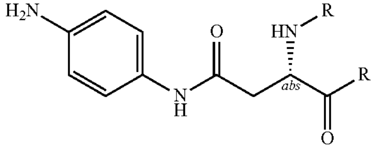 $C_{10}H_{11}N_3O_2R_2$ | Nc(cc1)ccc1NC(C[C@@H](C([R])=O)N[R])=O |
| 166 4MeOF | 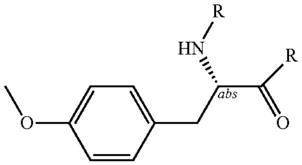 $C_{10}H_{11}NO_2R_2$ | COc1ccc(C[C@@H](C([R])=O)N[R])cc1COc1ccc(C[C@@H](C=O)N)cc1 |

TABLE 2C-continued
| Monomers | | | |
|---|---|---|---|
| # | Symbol/Name | Structure | Smiles |
| 167 | NMeDTyr, NMeDY, NMedTyr, NMedY, N-Methyl-D-tyrosine, dNMeTyr dNMeY | 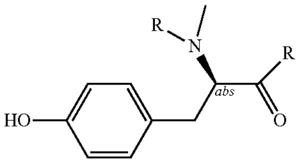 $C_{10}H_{11}NO_2R_2$ | CN([C@H](Cc(cc1)ccc1O)C([R])=O)[R] |
| 168 | aMe3OHPhe | 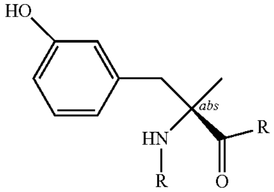 $C_{10}H_{11}NO_2R_2$ | C[C@](Cc1cc(O)ccc1)(C([R])=O)N[R] |
| 169 | aMeY, aMeTyr | 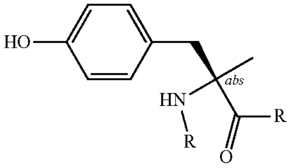 $C_{10}H_{11}NO_2R_2$ | C[C@](Cc(cc1)ccc1O)(C([R])=O)N[R] |
| 170 | bMeDTyr(2R,3S) bMeDTyr(2R,3S) | 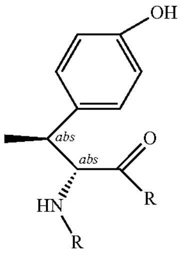 $C_{10}H_{11}NO_2R_2$ | C[C@H]([C@H](C([R])=O)N[R])c(cc1)ccc1O |

TABLE 2C-continued
| # | Symbol/Name | Structure | Smiles |
|---|---|---|---|
| | | Monomers | |
| 171 | 4MeF | 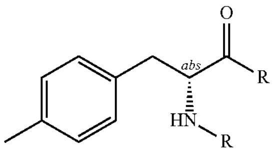 $C_{10}H_{11}NOR_2$ | Cc1ccc(C[C@@H](C([R])=O)N[R])cc1 |
| 172 | aMeF, aMeF alpha-methyl phenylalanine | 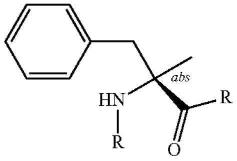 $C_{10}H_{11}NOR_2$ | C[C@](Cc1ccccc1)(C([R])=O)N[R]C[C@](Cc1ccccc1)(C=O)N |
| 173 | bMePhe | 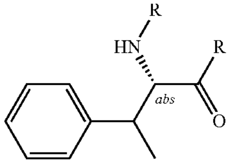 $C_{10}H_{11}NOR_2$ | CC([C@@H](C([R])=O)N[R])c1ccccc1 |
| 174 | bMePhe(2S3S) bMePhe(2S,3S) | 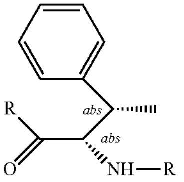 $C_{10}H_{11}NOR_2$ | C[C@H]([C@@H](C([R])=O)N[R])c1ccccc1 |
| 175 | hF, hPhe, homoF, homoPhe | 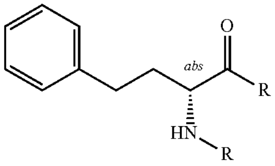 $C_{10}H_{11}NOR_2$ | O=C([C@H](CCc1ccccc1)N[R])[R] |

TABLE 2C-continued
| Monomers | | | |
|---|---|---|---|
| # | Symbol/Name | Structure | Smiles |
| 176 | F4CONH$_2$, 4-carbamoyl-L-phenylalanine | 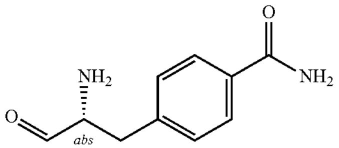 $C_{10}H_{12}N_2O_2$ | N[C@@H](Cc(cc1)ccc1C(N)=O)C=O |
| 177 | Maf | 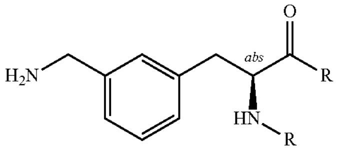 $C_{10}H_{12}N_2OR_2$ | NCc1cccc(C[C@@H](C([R])=O)N[R])c1 |
| 178 | Paf | 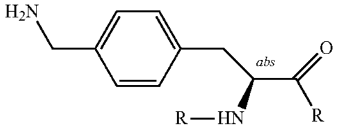 $C_{10}H_{12}N_2OR_2$ | NCc1ccc(C[C@@H](C([R])=O)N[R])cc1NCc1ccc(C[C@@H](C=O)N)cc1 |
| 179 | dMaf, maf | 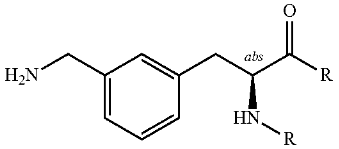 $C_{10}H_{12}N_2OR_2$ | NCc1cccc(C[C@H](C([R])=O)N[R])c1 |
| 180 | dPaf | 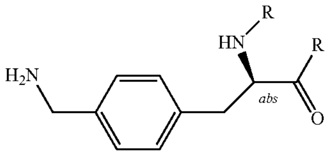 $C_{10}H_{12}N_2OR_2$ | NCc1ccc(C[C@H](C([R])=O)N[R])cc1 |

TABLE 2C-continued
| # | Symbol/Name | Structure | Smiles |
|---|---|---|---|
| | | Monomers | |
| 181 | oAMPhe | 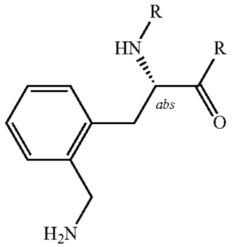 $C_{10}H_{12}N_2OR_2$ | NCc1c(C[C@@H](C([R])=O)N[R])cccc1 |
| | F(G) | 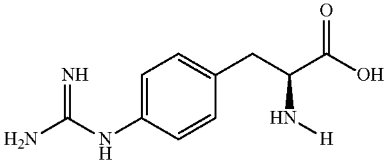 [SMILES: N=C(N)Nc1ccc(C[C@H](N)C(=O)O)cc1] (S)-2-amino-3-(4-guanidinophenyl)propanoic acid | OC([C@@H](N[H])CC1=CC=C(C=C1)NC(N)=N)=O |
| 182 | F(4G) | 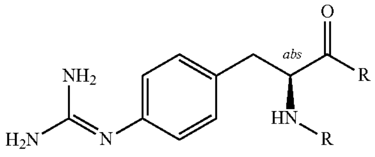 $C_{10}H_{12}N_4OR_2$ | NC(N)=Nc1ccc(C[C@@H](C([R])=O)N[R])cc1 |
| 183 | NMeDTyr | 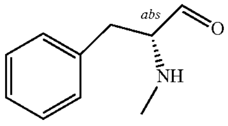 $C_{10}H_{13}NO$ | CN[C@H](Cc1ccccc1)C=O |
| 184 | dNMeTyr<br>dNMeY, D-N-methyl tyrosine<br>N-Methyl-D-tyrosine | 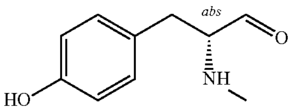 $C_{10}H_{13}NO_2$ | CN[C@H](Cc(cc1)ccc1O)C=O |

TABLE 2C-continued
| Monomers | | |
|---|---|---|
| # Symbol/Name | Structure | Smiles |
| 185 biotin | 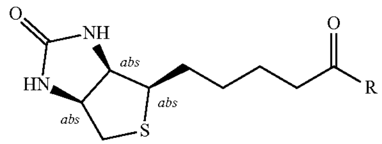 $C_{10}H_{15}N_2O_2SR$ | O═C(CCCC[C@@H]([C@H]1N2)SC[C@@H]1NC2═O)[R] |
| 186 K($CO_2$allyl) | 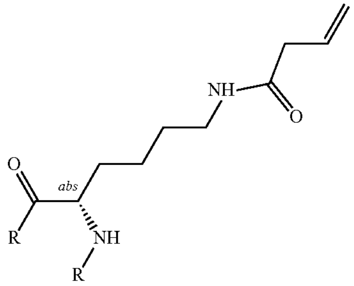 $C_{10}H_{16}N_2O_2R_2$ | C═CCC(NCCCC[c@@H](C([R])═O)N[R])═OC═CCOC(NCCCC[C@@H](C([R])═O)N[R])═O |
| 187 K(COcPr) | 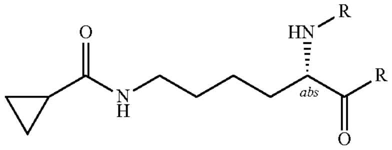 $C_{10}H_{16}N_2O_2R_2$ | O═C([C@H](CCCCNC(C1CC1)═O)N[R])[R] |
| 188 DAGSuc | 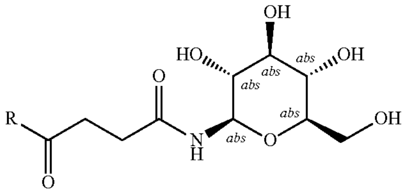 $C_{10}H_{16}NO_7R$ | OC[C@H]([C@H]([C@@H]([C@H]1O)O)O)O[C@H]1NC(CCC([R])═O)═O |

TABLE 2C-continued
| Monomers | | | |
|---|---|---|---|
| # | Symbol/Name | Structure | Smiles |
| 189 | K(COPr) | 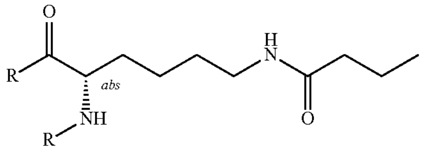 $C_{10}H_{18}N_2O_2R_2$ | CCCC(NCCCC[C@@H](C([R])=O)N[R])=O |
| 190 | K(COiPr) | 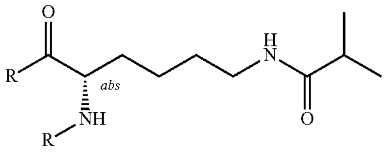 $C_{10}H_{18}N_2O_2R_2$ | CC(C)C(NCCCC[C@@H](C([R])=O)N[R])=O |
| 191 | Tzl(Ch) | 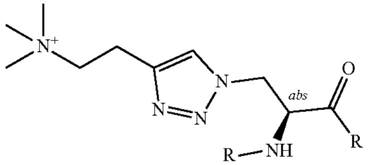 $C_{10}H_{18}N_5OR_2^+$ | C[N+](C)(C)CCc1cn(C[C@@H](C([R])=O)N[R])nn1 |
| 192 | hK(Me)3, hKMe3 | 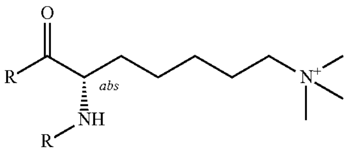 $C_{10}H_{21}N_2OR_2^+$ | C[N+](C)(C)CCCCC[C@@H](C([R])=O)N[R] |
| 193 | hdK(Me)3, hk(Me)3, hdKMe3 | 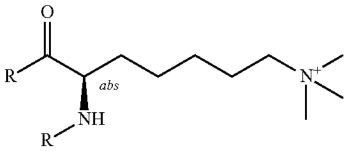 $C_{10}H_{21}N_2OR_2^+$ | C[N+](C)(C)CCCCC[C@H](C([R])=O)N[R] |

TABLE 2C-continued
| # Symbol/Name | Structure | Smiles |
|---|---|---|
| Monomers | | |
| 194 Dap(pF(6)) | 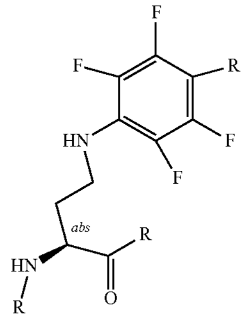 $C_{10}H_7F4N_2OR_3$ | O═C([C@H](CCNc(c(F)c(c([R])c1F)F)c1F)N[R])[R] |
| 195 4OCF3DPhe | 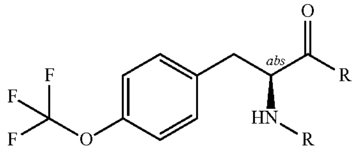 $C_{10}H_8F3NO_2R_2$ | O═C([C@@H](Cc(cc1)ccc1OC(F)(F)F)N[R])[R] |
| 196 CF3F | 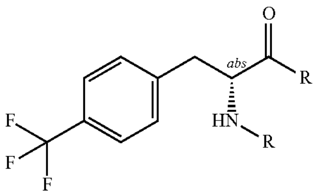 $C_{10}H_8F3NOR_2$ | O═C([C@H](Cc1ccc(C(F)(F)F)cc1)N[R])[R] |
| 197 7AzaW | 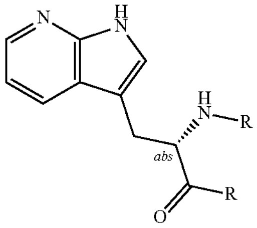 $C_{10}H_9N_3OR_2$ | O═C([C@H](Cc1c[nH]c2c1cccn2)N[R])[R] |

TABLE 2C-continued
| Monomers | | |
|---|---|---|
| # Symbol/Name | Structure | Smiles |
| 198 Y(CHF2) | 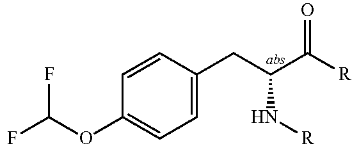<br>$C_{10}H_9F2NO_2R_2$ | O=C([C@H](Cc(cc1)ccc1OC(F)F)N[R])[R] |
| 199 CXF | 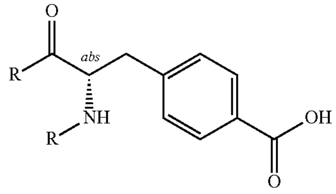<br>$C_{10}H_9NO_3R_2$ | OC(c1ccc(C[C@@H](C([R])=O)N[R])cc1)=O |
| 200 CHF2Phe | 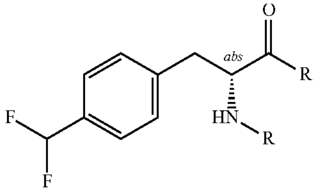<br>$C_{10}H_9F2NOR_2$ | O=C([C@H](Cc1ccc(C(F)F)cc1)N[R])[R] |
| 201 TetraFAEF | 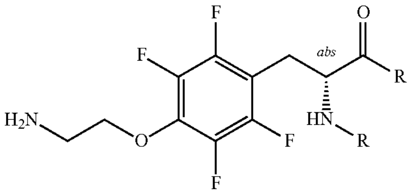<br>$C_{11}H_{10}F4N_2O_2R_2$ | NCCOc(c(F)c(c(C[C@@H](C([R])=O)N[R])c1F)F)c1F |

TABLE 2C-continued
| # Symbol/Name | Structure | Smiles |
|---|---|---|
| | Monomers | |
| 202 5OHW | 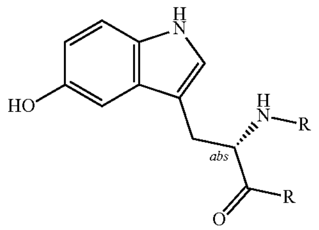 $C_{11}H_{10}N_2O_2R_2$ | Oc(cc1)cc2c1[nH]cc2C[C@@H](C([R])=O)N[R] |
| 203 4AcDPhe | 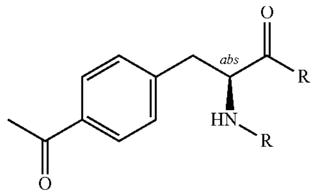 $C_{11}H_{11}NO_2R_2$ | CC(c1ccc(C[C@H](C([R])=O)N[R])cc1)=O |
| 204 D(NBzl) | 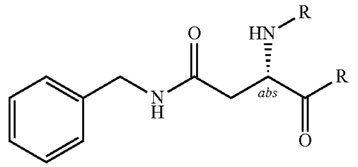 $C_{11}H_{12}N_2O_2R_2$ | O=C(C[C@@H](C([R])=O)N[R])NCc1ccccc1 |
| 205 aMe2AmTyr | 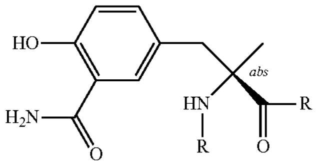 $C_{11}H_{12}N_2O_3R_2$ | C[C@](Cc(cc1)cc(C(N)=O)c1O)(C([R])=O)N[R] |

TABLE 2C-continued
| Monomers | | |
|---|---|---|
| # Symbol/Name | Structure | Smiles |
| 206 psiW | 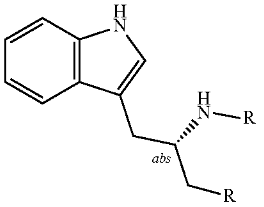 $C_{11}H_{12}N_2R_2$ | [R]C[C@H](Cc1c[nH]c2c1cccc2)N[R] |
| 207 aMeY01 | 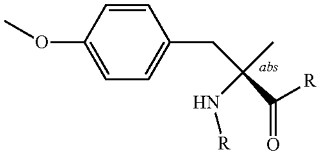 $C_{11}H_{13}NO_2R_2$ | C[C@](Cc(cc1)ccc1OC)(C([R])=O)N[R] |
| 208 3OMeY01 | 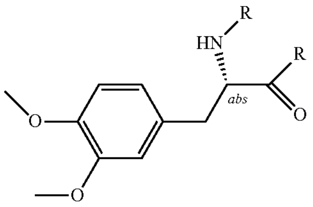 $C_{11}H_{13}NO_3R_2$ | COc(ccc(C[C@@H](C([R])=O)N[R])c1)c1OC |
| 209 | | |
| 210 dAEF | 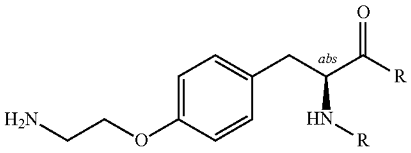 $C_{11}H_{14}N_2O_2R_2$ | NCCOc1ccc(C[C@H](C([R])=O)N[R])cc1 |

TABLE 2C-continued
| Monomers | | | |
|---|---|---|---|
| # | Symbol/Name | Structure | Smiles |
| 211 | K(COBu) | 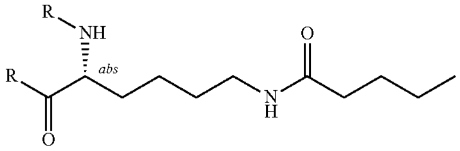 $C_{11}H_{20}N_2O_2R_2$ | CCCCC(NCCCC[C@@H](C([R])=O)N[R])=O |
| 212 | K(COiBu) | 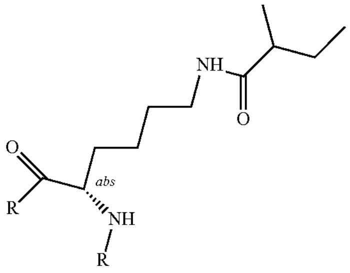 $C_{11}H_{20}N_2O_2R_2$ | CCC(C)C(NCCCC[C@@H](C([R])=O)N[R])= OCC(C)CC(NCCCC[C@@H](C([R])=O)N[R])=O |
| 213 | K(COtBu) | 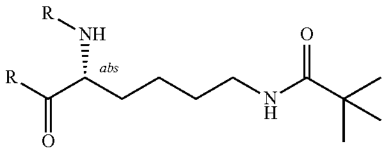 $C_{11}H_{20}N_2O_2R_2$ | CC(C)(C)C(NCCCC[C@@H](C([R])=O)N[R])=O |
| 214 | succiniccarn | 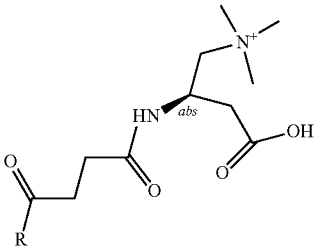 $C_{11}H_{20}N_2O_4R^+$ | C[N+](C)(C)C[C@@H](CC(O)=O)NC(CCC([R])=O)=O |

TABLE 2C-continued
| # | Symbol/Name | Structure | Smiles |
|---|---|---|---|
| | Monomers | | |
| 215 | Aun | 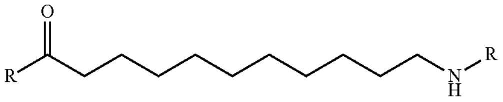 $C_{11}H_{21}NOR_2$ | O=C(CCCCCCCCCCN[R])[R] |
| 216 | 5BrW, 5BrTrp | 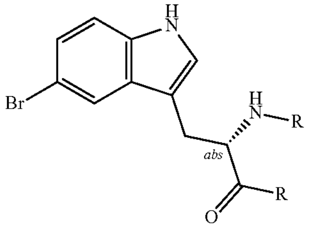 $C_{11}H_9BrN_2OR_2$ | O=C([C@H](Cc1c[nH]c(cc2)c1cc2Br)N[R])[R] |
| 217 | 7BrTrp, 7BrW | 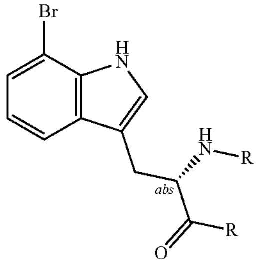 $C_{11}H_9BrN_2OR_2$ | O=C([C@H](Cc1c[nH]c2c1cccc2Br)N[R])[R] |
| 218 | 7ClW, 7ClTrp | 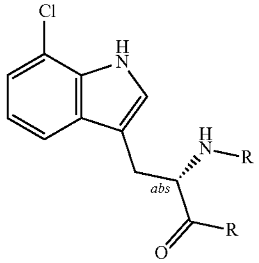 $C_{11}H_9ClN_2OR_2$ | O=C([C@H](Cc1c[nH]c2c1cccc2Cl)N[R][R] |

TABLE 2C-continued
| Monomers | | | |
|---|---|---|---|
| # | Symbol/Name | Structure | Smiles |
| 219 | 5FW, 5FTrp | 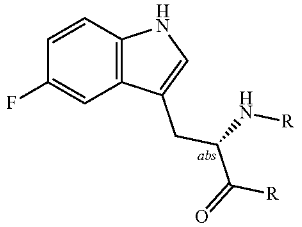 $C_{11}H_9FN_2OR_2$ | O=C([C@H](Cc1c[nH]c(cc2)c1cc2F)N[R][R] |
| 220 | 7FW, 7FTrp | 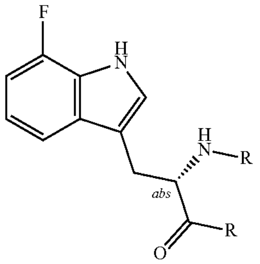 $C_{11}H_9FN_2OR_2$ | O=C([C@H](Cc1c[nH]c2c1cccc2F)N[R])[R] |
| 221 | BT, L-3-Benzothienylalanine | 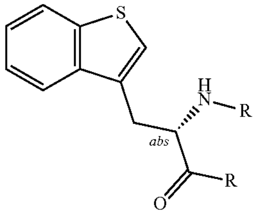 $C_{11}H_9NOSR_2$ | O=C([C@H](Cc1csc2c1cccc2)N[R])[R] |
| 222 | 2Quin 6OHQui | 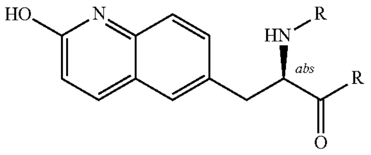 $C_{12}H_{10}N_2O_2R_2$ | Oc1ccc(cc(C[C@@H](C([R])=O)N[R])cc2)c2n1 |

TABLE 2C-continued
| Monomers | | | |
|---|---|---|---|
| # | Symbol/Name | Structure | Smiles |
| 223 | 7CF2H | 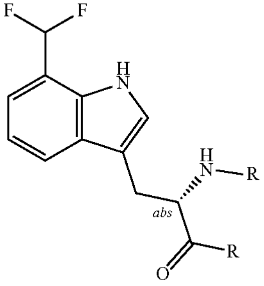 $C_{12}H_{10}F2N_2OR_2$ | O=C([C@H](Cc1c[nH]c2c1cccc2C(F)F)N[R])[R] |
| 224 | 3QuinolAla | 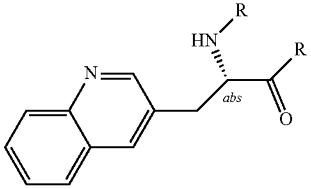 $C_{12}H_{10}N_2OR_2$ | O=C([C@H](Cc1cc2ccccc2nc1)N[R])[R] |
| 225 | 2MeTrp, 2MeW | 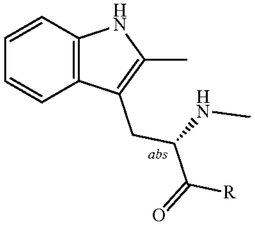 $C_{12}H_{12}N_2OR_2$ | Cc1c(C[C@@H](C([R])=O)N[R])c(cccc2)c2[nH]1 |

TABLE 2C-continued
| # | Symbol/Name | Structure | Smiles |
|---|---|---|---|
| | | Monomers | |
| 226 | 5MeW, 5MeTrp | 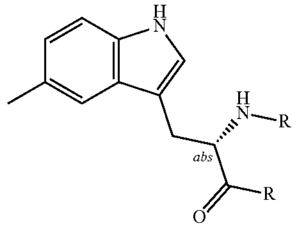 $C_{12}H_{12}N_2OR_2$ | Cc(cc1)cc2c1[nH]cc2C[C@@H](C([R])=O)N[R] |
| 227 | 7MeW, 7(MeW), 7MeTrp | 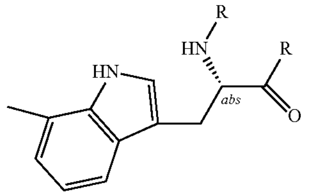 $C_{12}H_{12}N_2OR_2$ | Cc1cccc2c1[nH]cc2C[C@@H](C([R])=O)N[R]Cc1cccc2c1[nH]cc2C[C@@H](C=O)N |
| 228 | aMeW | 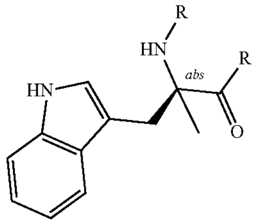 $C_{12}H_{12}N_2OR_2$ | C[C@](Cc1c[nH]c2c1cccc2)(C([R])=)N[R] |
| 229 | dW7Me, 7Mew, 7MedW | 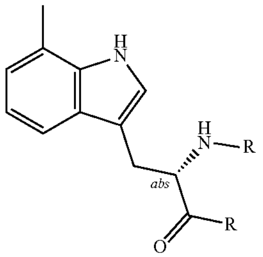 $C_{12}H_{12}N_2OR_2$ | Cc1cccc2c1[nH]cc2C[C@H](C([R])=O)N[R] |

TABLE 2C-continued
| Monomers | | | |
|---|---|---|---|
| # | Symbol/Name | Structure | Smiles |
| 230 | Y(OTzl) | 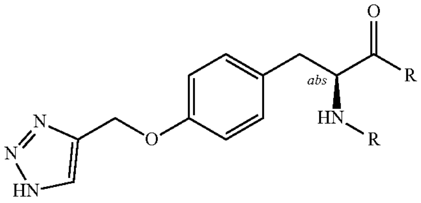 $C_{12}H_{12}N_4O_2R_2$ | O═C([C@H](Cc(cc1)ccc1OCc1c[nH]nn1)N[R])[R] |
| 231 | 4AllylY | 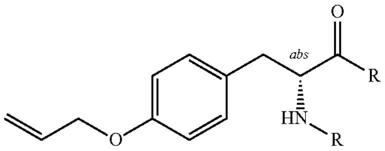 $C_{12}H_{13}NO_2R_2$ | C═CCOc1ccc(C[C@@H](C([R])═O)N[R])cc1 |
| 232 | 4AllylF | 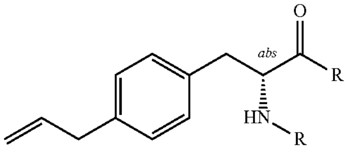 $C_{12}H_{13}NOR_2$ | C═CCc1ccc(C[C@@H](C([R])═O)N[R])cc1 |
| 233 | meW, NMeW, NMeTrp, N-Methyl-Tryptophan | 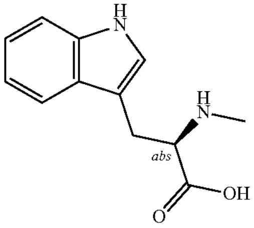 [SMILES: CN[C@H](Cc1c[nH]c2ccccc12)C(=O)O] $C_{12}H_{14}N_2O_2$ | CN[C@@H](Cc1c[nH]c2c1cccc2)C(O)═O |

TABLE 2C-continued
| Monomers | | | |
|---|---|---|---|
| # | Symbol/Name | Structure | Smiles |
| | AEF(G) | 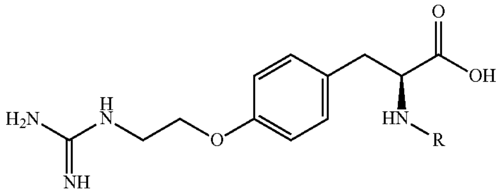 | [R]C([C@H](CC1=CC=C(OCCNC(N)=N)C=C1)N[R])=O |
| 234 | AAMPhe | 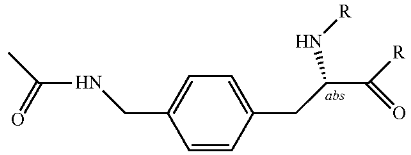 $C_{12}H_{14}N_2O_2R_2$ | CC(NCc1ccc(C[C@@H](C([R])=O)N[R])cc1)=OCC(NCc1ccc(C[C@@H](C=O)N)cc1)=O |
| 235 | hC(pXyl) | 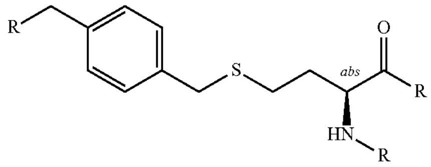 $C_{12}H_{14}NOSR_3$ | O=C([C@H](CCSCc1ccc(C[R])cc1)N[R])[R] |
| 236 | AEF(NMe(2)) | 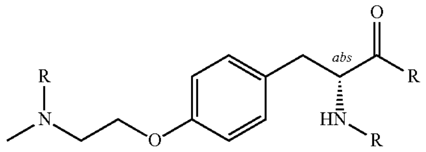 $C_{12}H_{15}N_2O_2R_3$ | CN(CCOc1ccc(C[C@@H](C([R])=O)N[R])cc1)[R] |
| 237 | DY02 | 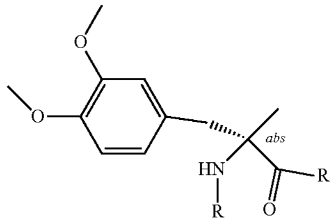 $C_{12}H_{15}NO_3R_2$ | C[C@@](Cc(cc1)cc(OC)c1OC)(C([R])=O)N[R] |

TABLE 2C-continued
| Monomers | | | |
|---|---|---|---|
| # | Symbol/Name | Structure | Smiles |
| 238 | Y02 | 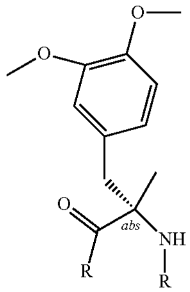 $C_{12}H_{15}NO_3R_2$ | C[C@](Cc(cc1)cc(OC)c1OC)(C([R])=O)N[R] |
| 239 | AEF(NMe) | 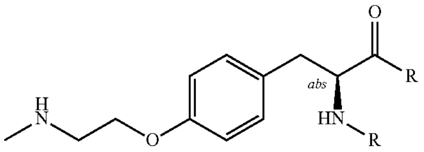 $C_{12}H_{16}N_2O_2R_2$ | CNCCOc1ccc(C[c@@H](C([R])=O)N[R])cc1 |
| 240 | NMeAEF | 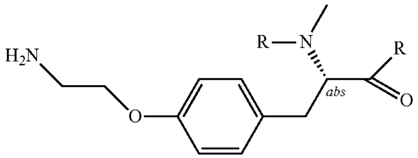 $C_{12}H_{16}N_2O_2R_2$ | CN([C@@H](Cc(cc1)ccc1OCCN)C([R])=O)[R]CN[C@@H](Cc(cc1)ccc1OCCN)C=O |
| 241 | aMeAEF | 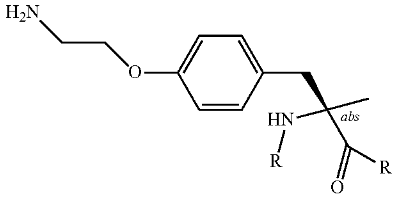 $C_{12}H_{16}N_2O_2R_2$ | C[C@](Cc(cc1)ccc1OCCN)(C([R])=<br>O)N[R]CC(C)(C)OC(NCCOc1ccc(C[C@@](C)(C([R])=O)N[R])cc1)=O |

TABLE 2C-continued

| Monomers | | | |
|---|---|---|---|
| # | Symbol/Name | Structure | Smiles |
| 242 | bMeAEF | 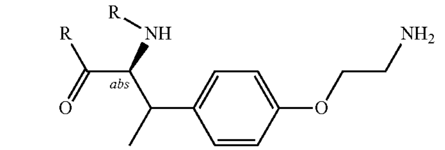<br>$C_{12}H_{16}N_2O_2R_2$ | CC([C@@H](C([R])=O)N[R])c(cc1)ccc1OCCN |
| 243 | bMeAEF(2S,3R*), bMeAEF(2S3R*) (*pure but configuration unknown) | 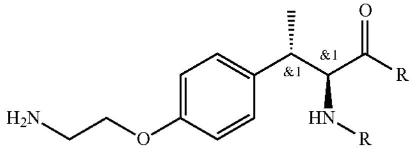<br>$C_{12}H_{16}N_2O_2R_2$ | C[C@@H]([C@@H](C([R])=O)N[R])c(cc1)ccc1OCCN |
| 244 | bMeAEF(2S3S*), bMeAEF(2S,3S*) (*pure but configuration unknown) | 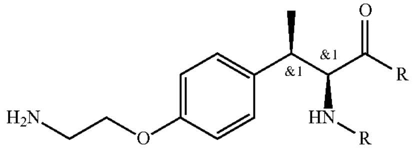<br>$C_{12}H_{16}N_2O_2R_2$ | C[C@H]([C@@H](C([R])=O)N[R])c(cc1)ccc1OCCN |
| 245 | K(Morph) | 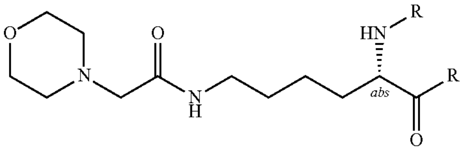<br>$C_{12}H_{21}N_3O_3R_2$ | O=C(CN1CCOCC1)NCCCC[C@@H](C([R])=O)N[R] |
| 246 | K(COPent) | 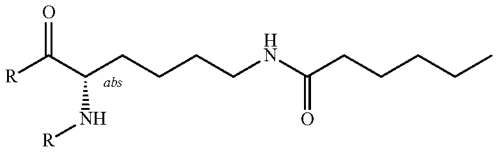<br>$C_{12}H_{22}N_2O_3R_2$ | CCCCCC(NCCCC[C@@H](C([R])=O)N[R])=O |

TABLE 2C-continued
| Monomers | | | |
|---|---|---|---|
| # | Symbol/Name | Structure | Smiles |
| 247 | aMeK(Boc) | 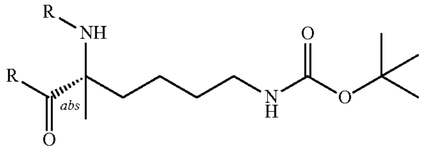 $C_{12}H_{22}N_2O_3R_2$ | CC(C)(C)OC(NCCCC[C@@](C)(C([R])=O)N[R])=O |
| 248 | E(C) | 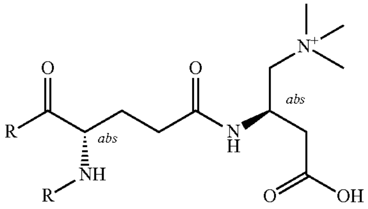 $C_{12}H_{22}N_3O_4R_2^+$ | C[N+](C)(C)C[C@H](CC(O)=O)NC(CC[C@@H](C([R])=O)N[R])=O |
| 249 | E(c) (R)-2-((R)-4-amino-4-carboxybutanamido)-3-carboxy-N,N,N-trimethylpropan-1-aminium, E(c) | 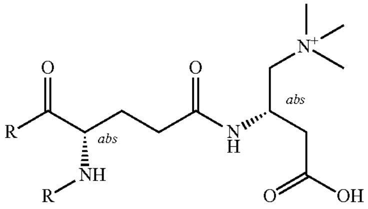 $C_{12}H_{22}N_3O_4R_2^+$ | C[N+](C)(C)C[C@@H](CC(O)=O)NC(CC[C@@H](C([R])=O)N[R])=O |
| 250 | e(C), dE(C) | 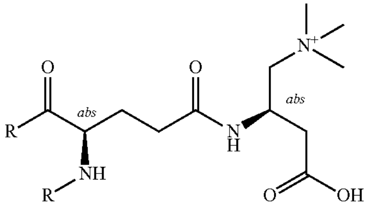 $C_{12}H_{22}N_3O_4R_2^+$ | C[N+](C)(C)C[C@H](CC(O)=O)NC(CC[C@H](C([R])=O)N[R])=O |

TABLE 2C-continued
| # | Symbol/Name | Structure | Smiles |
|---|---|---|---|
| | Monomers | | |
| 251 | e(c), dE(c) | 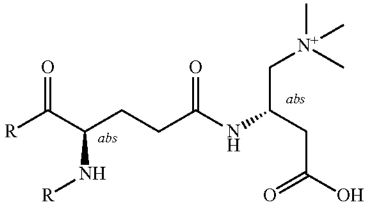 $C_{12}H_{22}N_3O_4R_2^+$ | C[N+](C)(C)C[C@@H](CC(O)=O)NC(CC[C@H](C([R])=O)N[R])=O |
| 252 | dK(SP6), k(SP6) | 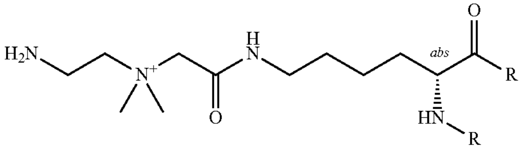 $C_{12}H_{25}N_4O_2R_2^+$ | C[N+](C)(CCN)CC(NCCCC[C@H](C([R])=O)N[R])=O |
| 253 | 7CF3W, (S)-2-amino-3-(7-(trifluoromethyl)-1H-indol-3-yl)propanoic acid | 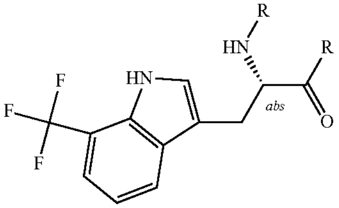 $C_{12}H_9F3N_2OR_2$ | O=C([C@H](Cc1c[nH]c2c1cccc2C(F)(F)F)N[R])[R]N[C@@H](Cc1c[nH]c2c(C(F)(F)F)cccc12)C=ON[C@@H](Cc1c[nH]c2c(C(F)(F)F)cccc12)C=O |
| 254 | 5BR$_2$Nal | 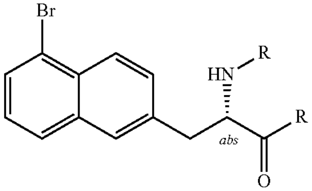 $C_{13}H_{10}BrNOR_2$ | O=C([C@H](Cc1cc2cccc(Br)c2cc1)N[R])[R] |

TABLE 2C-continued
| Monomers | | |
|---|---|---|
| # Symbol/Name | Structure | Smiles |
| 255 $6BR_2Nal$ | 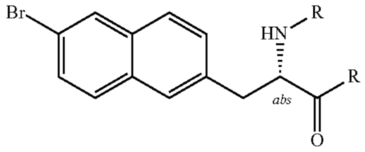 $C_{13}H_{10}BrNOR_2$ | O═C([C@H](Cc(ccc1c2)cc1ccc2Br)N[R])[R] |
| 256 $7BR_2Nal$ | 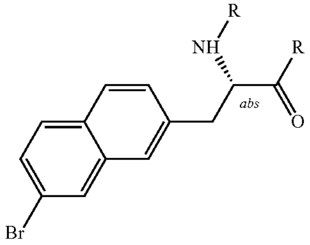 $C_{13}H_{10}BrNOR_2$ | O═C([C@H](Cc1cc2cc(Br)ccc2cc1)N[R])[R] |
| 257 6F2Nal | 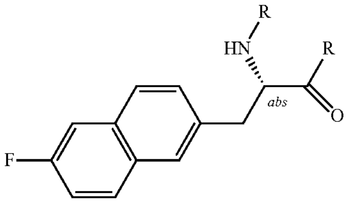 $C_{13}H_{11}NO_2R_2$ | O═C([C@H](Cc(ccc1c2)cc1ccc2F)N[R])[R]N[C@@H](Cc1ccc(cc(cc2)F)c2c1)C═O |
| 258 $7OH_2Nal$ | 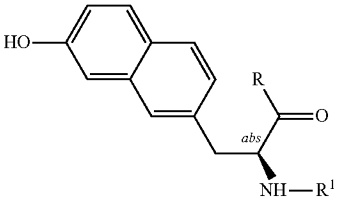 $C_{13}H_{10}BrFNOR_2$ | Oc1ccc(ccc(C[C@@H](C([R])═O)N[R1])c2)c2c1 |

TABLE 2C-continued
| Monomers | | | |
|---|---|---|---|
| # | Symbol/Name | Structure | Smiles |
| 259 | 1Nal, Nal, | 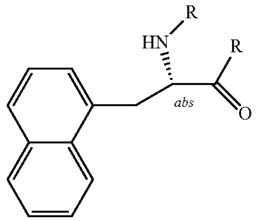<br>$C_{13}H_{11}NOR_2$ | O=C([C@H](Cc1cccc2ccccc12)N[R])[R] |
| 260 | 2Nal | 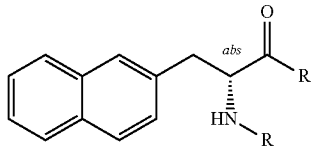<br>$C_{13}H_{11}NOR_2$ | O=C([C@H](Cc1cc2ccccc2cc1)N[R])[R] |
| 261 | dNal, d2Nal | 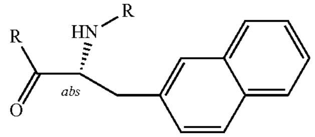<br>$C_{13}H_{11}NOR_2$ | O=C([C@@H](Cc1cc2ccccc2cc1)N[R])[R] |
| 262 | 6MeQui | 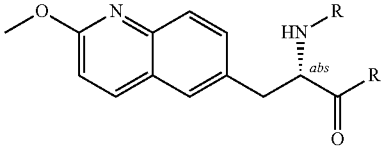<br>$C_{13}H_{12}N_2O_2R_2$ | COc1ccc(cc(C[C@@H](C([R])=O)N[R])cc2)c2n1 |
| 263 | D($N_5$In) | 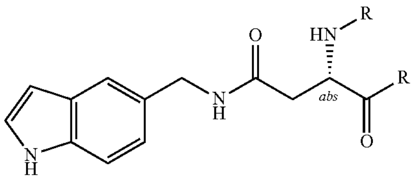<br>$C_{13}H_{13}N_3O_2R_2$ | O=C(C[C@@H](C([R])=O)N[R])NCc(cc1)cc2c1[nH]cc2 |

TABLE 2C-continued
| Monomers | | | |
|---|---|---|---|
| # | Symbol/Name | Structure | Smiles |
| 264 | psi2Nal | 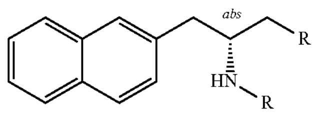 $C_{13}H_{13}NR_2$ | [R]C[C@H](Cc1cc2ccccc2cc1)N[R] |
| 265 | 7EtW | 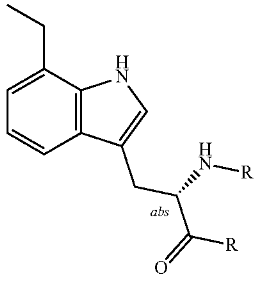 $C_{13}H_{14}N_2OR_2$ | CCc1cccc2c1[nH]cc2C[C@@H](C([R])=O)N[R] |
| 266 | F(4TzIMME) | 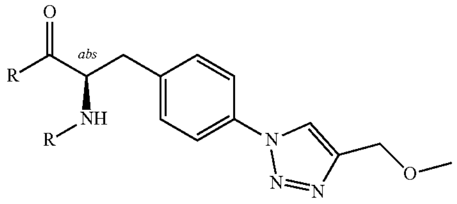 $C_{13}H_{14}N_4O_2R_2$ | COCc1cn(-c2ccc(C[C@@H](C([R])=O)N[R])cc2)nn1 |
| 267 | AcAEF | 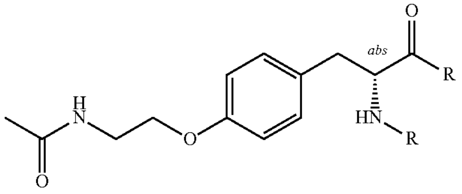 $C_{13}H_{16}N_2O_3R_2$ | CC(NCCOc1ccc(C[C@@H](C([R])=O)N[R])cc1)=O |

TABLE 2C-continued
| Monomers | | |
|---|---|---|
| # Symbol/Name | Structure | Smiles |
| 268 tButY, Y(tBu) | 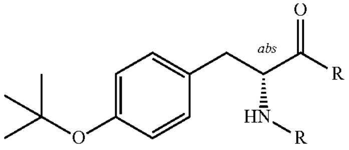 $C_{13}H_{17}NO_2R_2$ | CC(C)(C)Oc1ccc(C[C@H](C([R])=O)N[R])cc1 |
| 269 AEF(Me)2 | 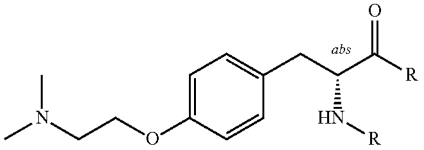 $C_{13}H_{18}N_2O_2R_2$ | CN(C)CCOc1ccc(C[C@@H](C([R])=O)N[R])cc1 |
| 270 Z, Amp | 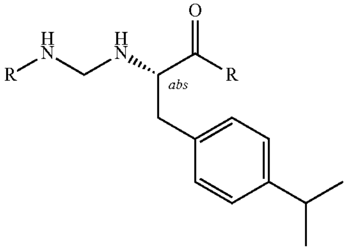 $C_{13}H_{18}N_2OR_2$ | CC(C)c1ccc(C[C@@H](C([C[R])=O)NCN[R])cc1 |
| 271 5amidO$_2$Nal | 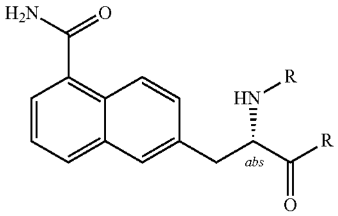 $C_{14}H_{12}N_2O_2R_2$ | NC(c1c(ccc(C[C@@H](C([R])=O)N[R])c2)c2ccc1)=O |

TABLE 2C-continued
| Monomers | | |
|---|---|---|
| # Symbol/Name | Structure | Smiles |
| 272 6amid$O_2$Nal | 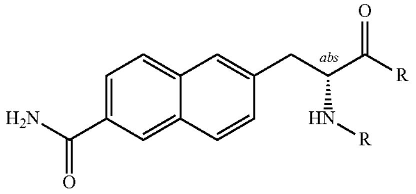<br>$C_{14}H_{12}N_2O_2R_2$ | NC(c1ccc(cc(C[C@@H](C([R])=O)N[R])cc2)c2c1)=O |
| 273 5OMe2Nal | 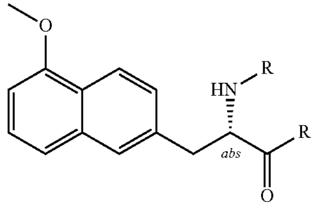<br>$C_{14}H_{13}NO_2R_2$ | COc1c(ccc(C[C@@H](C([R])=O)N[R])c2)c2ccc1 |
| 274 6OMe2Nal | 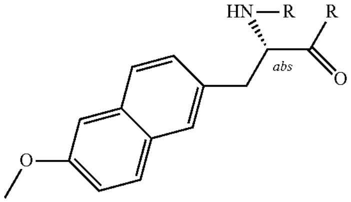<br>$C_{14}H_{13}NO_2R_2$ | COc1ccc(cc(C[C@@H](C([R])=O)N[R])cc2)c2c1 |
| 275 5Me2Nal | 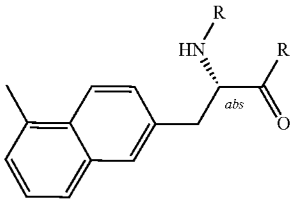<br>$C_{14}H_{13}NOR_2$ | Cc1c(ccc(C[C@@H](C([R])=O)N[R])c2)c2ccc1 |

TABLE 2C-continued
| # | Symbol/Name | Structure | Smiles |
|---|---|---|---|
| | | Monomers | |
| 276 | NMe2NAL | 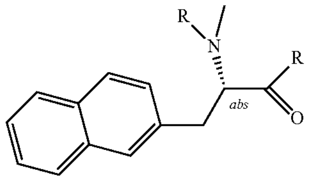<br>$C_{14}H_{13}NOR_2$ | CN([C@@H](Cc1cc2ccccc2cc1)C([R])=O)[R]CN[C@@H](Cc1cc2ccccc2cc1)C=O |
| 277 | aMe2Nal | 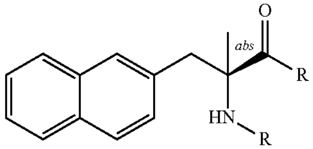<br>$C_{14}H_{13}NOR_2$ | C[C@](Cc1cc2ccccc2cc1)(C([R])=O)N[R] |
| 278 | bMe2Nal(2S,3R),<br>bMe2Nal(2S3R) | 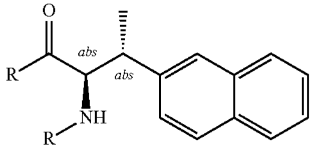<br>$C_{14}H_{13}NOR_2$ | C[C@@H]([C@@H](C([R])=O)N[R])c1cc2ccccc2cc1 |
| 279 | bMe2Nal(2S3S),<br>bMe2Nal(2S3R) | 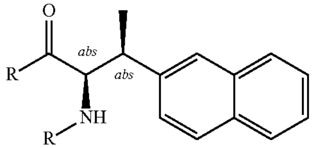<br>$C_{14}H_{13}NOR_2$ | C[C@H]([C@@H](C([R])=O)N[R])c1cc2ccccc2cc1 |
| 280 | AEF(EtCO) | 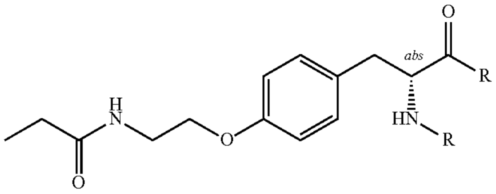<br>$C_{14}H_{18}N_2O_3R_2$ | CCC(NCCOc1ccc(C[C@@H](C([R])=O)N[R])cc1)=O |

TABLE 2C-continued
| Monomers | | |
|---|---|---|
| # Symbol/Name | Structure | Smiles |
| 281 NMeY(tBu) | 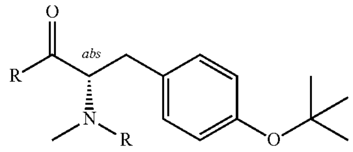 $C_{14}H_{19}NO_2R_2$ | CC(C)(C)Oc1ccc(C[C@H](C([R])=O)N(C)[R])cc1 |
| 282 AEF(NMe3) | 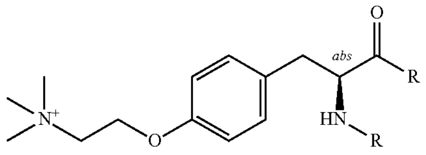 $C_{14}H_{21}N_2O_2R_2^+$ | C[N+](C)(C)CCOc1ccc(C[C@@H](C([R])=O)N[R])cc1 |
| 283 60(COCF3)2Nal | 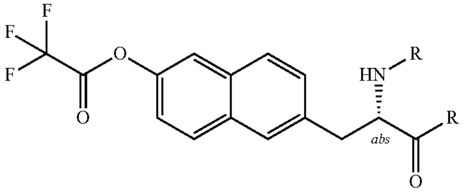 $C_{15}H_{10}F3NO_3R_2$ | O=C([C@H](Cc(ccc1c2)cc1ccc2OC(C(F)(F)F)=O)N[R])[R] |
| 284 BIF | 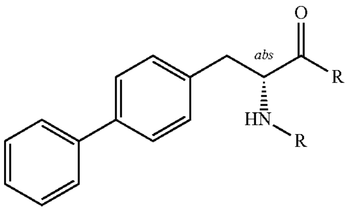 $C_{15}H_{13}NOR_2$ | O=C([C@H](Cc(cc1)ccc1-c1ccccc1)N[R])[R] |

TABLE 2C-continued
| Monomers | | |
|---|---|---|
| # Symbol/Name | Structure | Smiles |
| 285 DiPhAla | 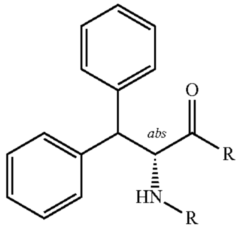<br>$C_{15}H_{13}NOR_2$ | O=C([C@H](C(c1ccccc1)c1ccccc1)N[R][R] |
| 286 5Et2Nal | 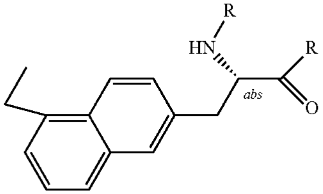<br>$C_{15}H_{15}NOR_2$ | CCc1c(ccc(C[C@@H](C([R])=O)N[R])c2)c2ccc1 |
| 287 CMF | 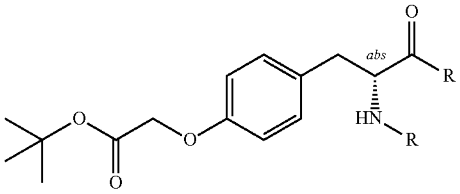<br>$C_{15}H_{19}NO_4R_2$ | CC(C)(C)OC(COc1ccc(C[C@@H](C([R])=O)N[R])cc1)=O |
| 288 F(4TzlTMA1) | 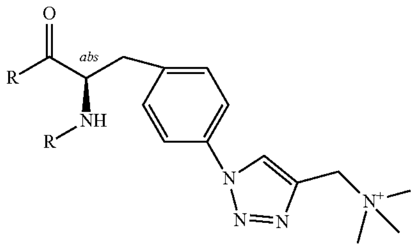<br>$C_{15}H_{20}N_5OR_2^+$ | C[N+](C)(C)Cc1cn(-c2ccc(C[C@@H](C([R])=O)N[R])cc2)nn1 |

TABLE 2C-continued
| Monomers | | | |
|---|---|---|---|
| # | Symbol/Name | Structure | Smiles |
| 289 | PiperazinequatF | 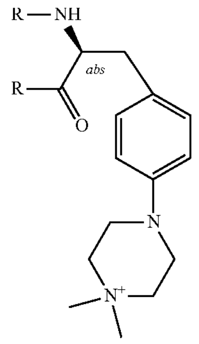 $C_{15}H_{22}N_3OR_2^+$ | C[N+](C)(CC1)CCN1c1ccc(C[C@@H](C([R])=O)N[R])cc1 |
| 290 | TMA3F | 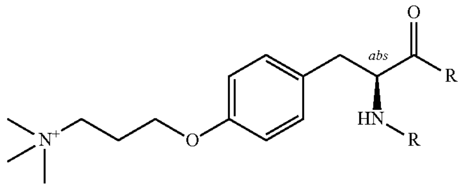 $C_{15}H_{23}N_2O_2R_2^+$ | C[N+](C)(C)CCCOc1ccc(C[C@@H](C([R])=O)N[R])cc1 |
| 291 | TMA4F | 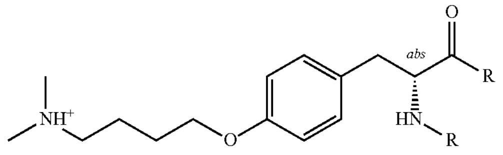 $C_{15}H_{23}N_2O_2R_2^+$ | C[NH+](C)CCCCOc1ccc(C[C@@H](C([R])=O)N[R])cc1 |
| 292 | K5cpa, K(5cpa), K(5cpaCO) | 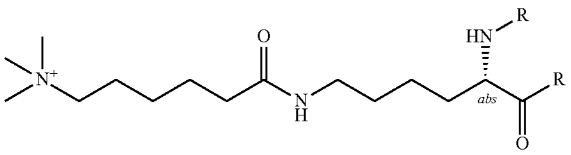 $C_{15}H_{30}N_3O_2R_2^+$ | C[N+](C)(C)CCCCCC(NCCCC[C@@H](C([R])=O)N[R])=O |

TABLE 2C-continued
| # | Symbol/Name | Structure | Smiles |
|---|---|---|---|
| | Monomers | | |
| 293 | dK(5cpa), k(5cpa), k(5cpaCO) | 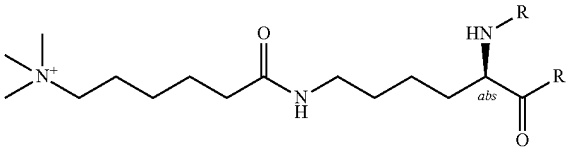 $C_{15}H_{30}N_3O_2R_2^+$ | C[N+](C)(C)CCCCCC(NCCCC[C@H](C([R])=O)N[R])=O |
| 294 | 2Nal6(3pyrazole) | 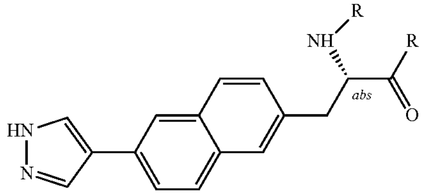 $C_{16}H_{13}N_3OR_2$ | O=C([C@H](Cc(ccc1c2)cc1ccc2-c1c[nH]nc1)N[R])[R] |
| 295 | 7PyrTrp | 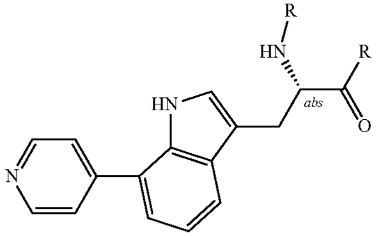 $C_{16}H_{13}N_3OR_2$ | O=C([C@H](Cc1c[nH]c2c1cccc2-c1ccncc1)N[R])[R] |
| 296 | 4BzF | 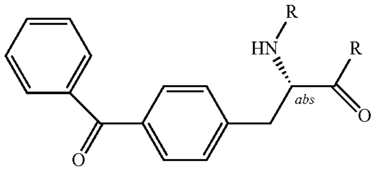 $C_{16}H_{13}NO_2R_2$ | O=C([C@H](Cc(cc1)ccc1C(c1ccccc1)=O)N[R])[R] |

TABLE 2C-continued
| Monomers | | |
|---|---|---|
| # Symbol/Name | Structure | Smiles |
| 297 aMeBiF | 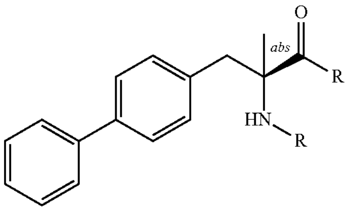 $C_{16}H_{15}NOR_2$ | C[C@](Cc(cc1)ccc1-c1ccccc1)(C([R])=O)N[R] |
| 298 NPyEF | 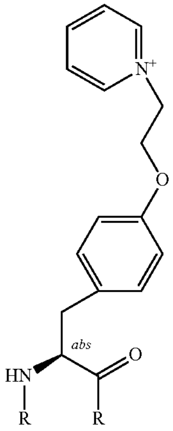 $C_{16}H_{17}N_2O_2R_2^+$ | O=C([C@H](Cc(cc1)ccc1OCC[n+]1ccccc1)N[R])[R] |
| 299 5iPR$_2$Nal | 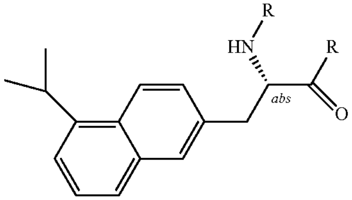 $C_{16}H_{17}NOR_2$ | CC(C)c1c(ccc(C[C@@H](C([R])=O)N[R])c2)c2ccc1 |

TABLE 2C-continued
| # | Symbol/Name | Structure | Smiles |
|---|---|---|---|
| | Monomers | | |
| 300 | TetraFAEF(Boc) | 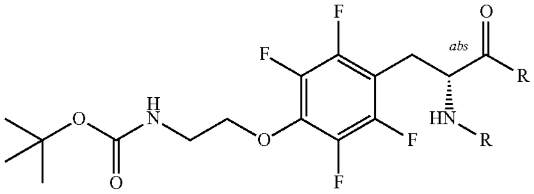 $C_{16}H_{18}F4N_2O_4R_2$ | CC(C)(C)OC(NCCOc(c(F)c(c(C[C@@H](C([R])=O)N[R])c1F)F)c1F)=O |
| 301 | 4TMABYF | 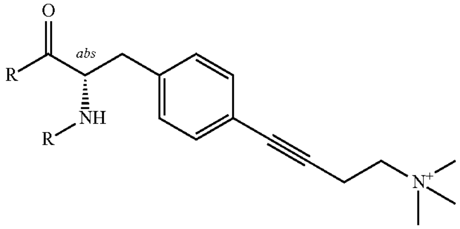 $C_{16}H_{21}N_2OR_2^+$ | C[N+](C)(C)CCC#Cc1ccc(C[C@@H](C([R])=O)N[R])cc1 |
| 302 | AEF(Boc) | 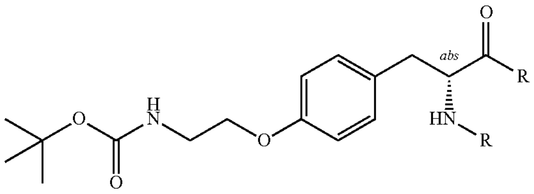 $C_{16}H_{22}N_2O_4R_2$ | CC(C)(C)OC(NCCOc1ccc(C[C@@H](C([R])=O)N[R])cc1)=O |

TABLE 2C-continued
| Monomers | | |
|---|---|---|
| # Symbol/Name | Structure | Smiles |
| 303 F(4TzlTMA2) | 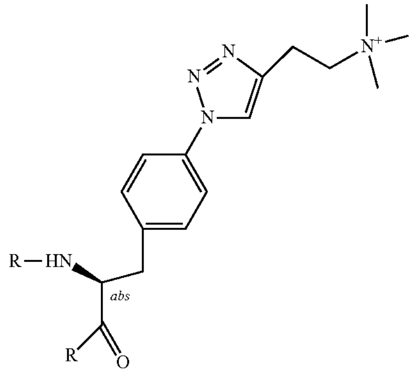 $C_{16}H_{22}N_5OR_2^+$ | C[N+](C)(C)CCc1cn(-c2ccc(C[C@@H](C([R])=O)N[R])cc2)nn1 |
| 304 DMPMF | 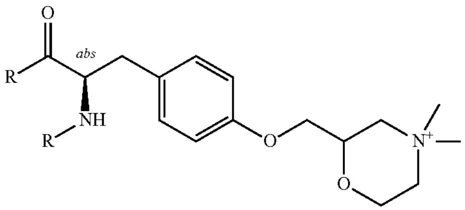 $C_{16}H_{23}N_2O_3R_2^+$ | C[N+]1(C)CC(COc2ccc(C[C@@H](C([R])=O)N[R])cc2)OCC1 |
| 305 KDde, K(Dde) | 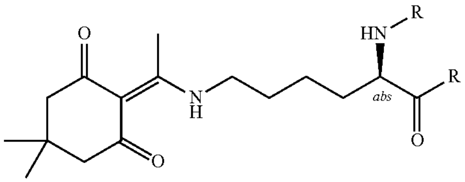 $C_{16}H_{24}N_2O_3R_2$ | CC(C)(CC(C1=C(C)NCCCC[C@@H](C([R])=O)N[R])=O)CC1=O |

TABLE 2C-continued
| Monomers | | | |
|---|---|---|---|
| # | Symbol/Name | Structure | Smiles |
| 306 | dKDde, k(Dde), dK(Dde) | 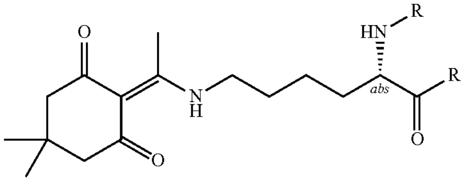 $C_{16}H_{24}N_2O_3R_2$ | CC(C)(CC(C1=C(C)NCCCC[C@H](C([R])=O)N[R])=O)CC1=O |
| 307 | Y(OEOXIMECh) | 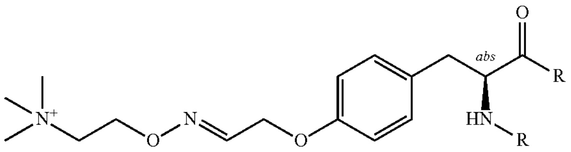 $C_{16}H_{24}N_3O_3R_2^+$ | C[N+](C)(C)CCO/N=C/COc1ccc(C[C@@H](C([R])=O)N[R])cc1 |
| 308 | Y(OZOXIMECh) | 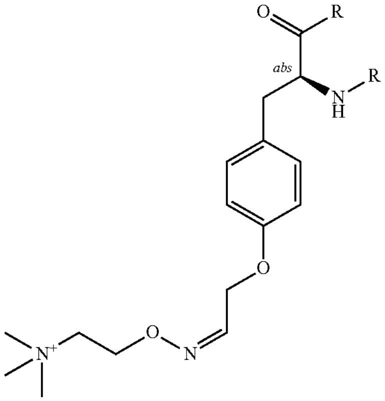 $C_{16}H_{24}N_3O_3R_2^+$ | C[N+](C)(C)CCO/N=C\COc1ccc(C[C@@H](C([R])=O)N[R])cc1 |

TABLE 2C-continued
| # | Symbol/Name | Structure | Smiles |
|---|---|---|---|
| | Monomers | | |
| 309 | AEF(NHCh) | 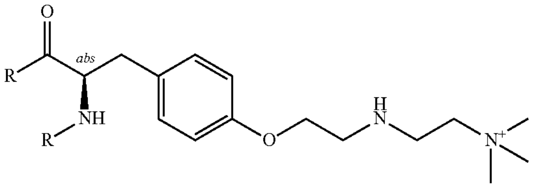 $C_{16}H_{26}N_3O_2R_2^+$ | C[N+](C)(C)CCNCCOc1ccc(C[C@@H](C([R])=O)N[R])cc1 |
| 310 | K(Biotina), K(Biotin) | 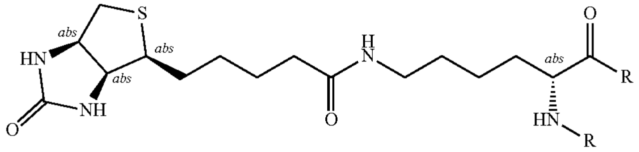 $C_{16}H_{26}N_4O_3SR_2$ | O=C(CCCC[C@H]([C@@H]1N2)SC[C@H]1NC2=O)NCCCC[C@@H](C([R])=O)N[R] |
| 311 | K(DAGSuc) | 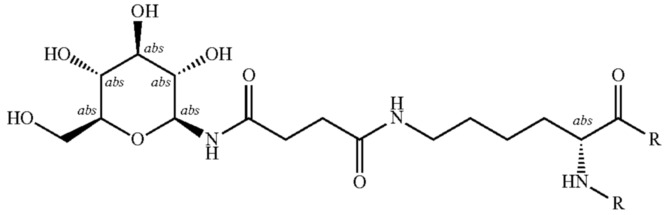 $C_{16}H_{27}N_3O_8R_2$ | OC[C@H]([C@H]([C@@H]([C@H]1O)O)O)O[C@H]1NC(CCC(NCCCC[C@@H](C([R])=O)N[R])=O)=O |
| 312 | k(DAGSuc), dK(DAGSuc) | 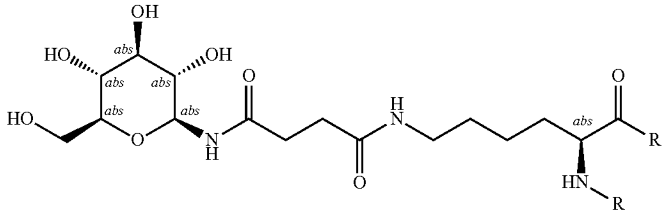 $C_{16}H_{27}N_3O_8R_2$ | OC[C@H]([C@H]([C@@H]([C@H]1O)O)O)O[C@H]1NC(CCC(NCCCC[C@H](C([R])=O)N[R])=O)=O |

TABLE 2C-continued
| Monomers | | |
|---|---|---|
| # Symbol/Name | Structure | Smiles |
| 313 DOTA | 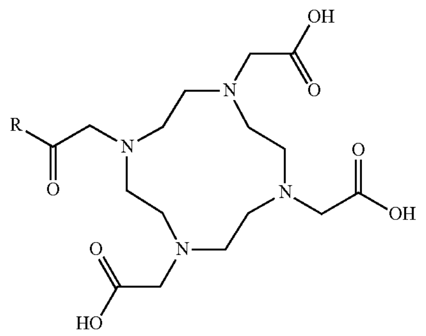 $C_{16}H_{27}N_4O_7R$ | OC(CN1CCN(CC(O)═O)CCN(CC([R])═O)CCN(CC(O)═O)CC1)═O |
| 314 Dab(NMeCarn) | 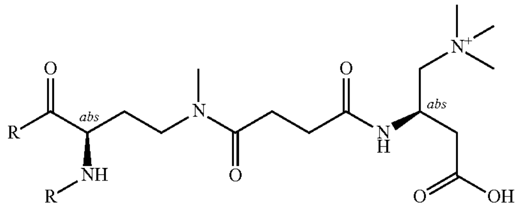 $C_{16}H_{29}N_4O_5R_2^+$ | CN(CC[C@@H](C([R])═O)N[R])C(CCC(N[C@@H](CC(O)═O)C[N+](C)(C)C)═O)═O |
| 315 Dab(NMecarn) | 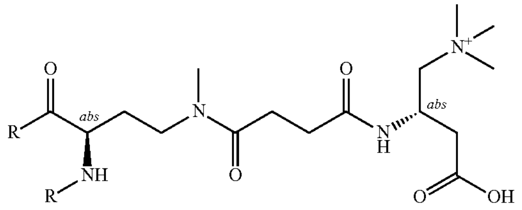 $C_{16}H_{29}N_4O_5R_2^+$ | CN(CC[C@@H](C([R])═O)N[R])C(CCC(N[C@H](CC(O)═O)C[N+](C)(C)C)═O)═O |

TABLE 2C-continued
| # Symbol/Name | Structure | Smiles |
| --- | --- | --- |
| | Monomers | |
| 316 orn(d) | 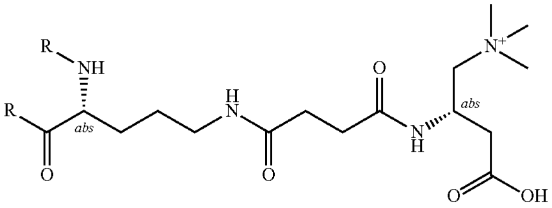 $C_{16}H_{29}N_4O_5R_2^+$ | C[N+](C)(C)C[C@@H](CC(O)=O)NC(CCC(NCCC[C@H](C([R])=O)N[R])=O)=O |
| 317 2Nal6((5CF3)3pyrazole) | 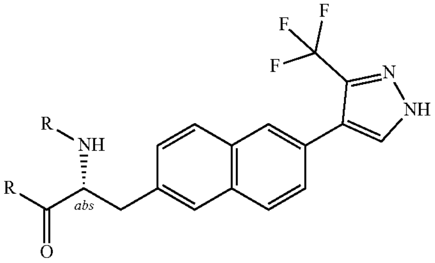 $C_{17}H_{12}F3N_3OR_2$ | O=C([C@H](Cc(ccc1c2)cc1ccc2-c1c[nH]nc1C(F)(F)F)N[R])[R] |
| 318 7(2ClPh)W | 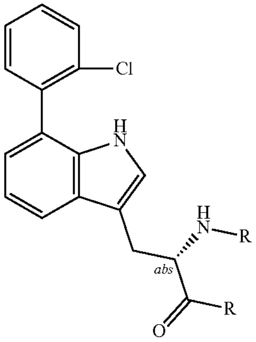 $C_{17}H_{13}ClN_2OR_2$ | O=C([C@H](Cc1c[nH]c2c1cccc2-c(cccc1)c1Cl)N[R])[R] |

TABLE 2C-continued
| Monomers | | | |
|---|---|---|---|
| # | Symbol/Name | Structure | Smiles |
| 319 | TMAPF | 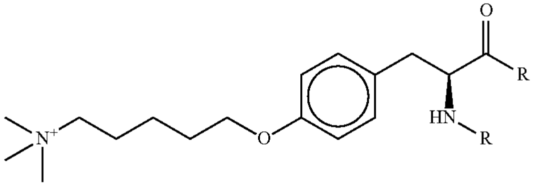 | C[N+](C)(CCCCCOc1ccc(C[C@H](N[R])C([R])=O)cc1)C |
| 320 | 7(2OMe5Pyr)W | 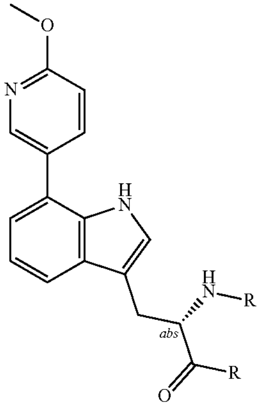 $C_{17}H_{15}N_3O_2R_2$ | COc(cc1)ncc1-c1cccc2c1[nH]cc2C[C@@H](C([R])=O)N[R] |
| 321 | W-7Ph, 7-phenyl-L-tryptophan | 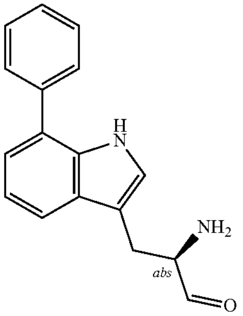 [SMILES: N[C@@H](C=O)Cc1c[nH]c2c(-c3ccccc3)cccc12] $C_{17}H_{16}N_2O$ | N[C@@H](Cc1c[nH]c2c1cccc2-c1ccccc1)C=O |

TABLE 2C-continued
| Monomers | | | |
|---|---|---|---|
| # | Symbol/Name | Structure | Smiles |
| 322 | $5OH_2Nal$ | 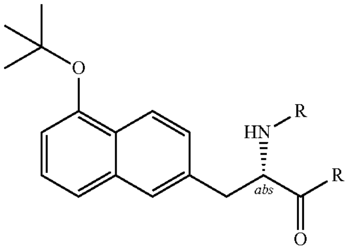 $C_{17}H_{19}NO_2R_2$ | CC(C)(C)Oc1c(ccc(C[C@@H](C([R])=O)N[R])c2)c2ccc1 |
| 323 | 5tBu2Nal | 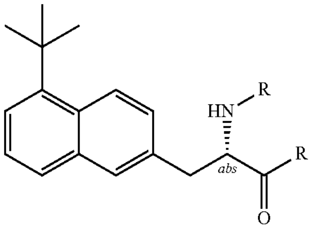 $C_{17}H_{19}NOR_2$ | CC(C)(C)c1c(ccc(C[C@@H](C([R])=O)N[R])c2)c2ccc1 |
| 324 | hFTMAPF | 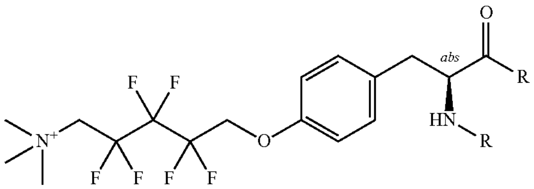 $C_{17}H_{21}F6N_2O_2R_2^+$ | C[N+](C)(C)CC(C(C(COc1ccc(C[C@@H](C([R])=O)N[R])cc1)(F)F)(F)F)(F)F |
| 325 | F(4TzlTMA3) | 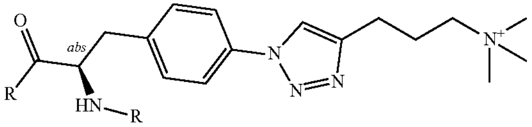 $C_{17}H_{24}N_5OR_2^+$ | C[N+](C)(C)CCCc1cn(-c2ccc(C[C@@H](C([R])=O)N[R])cc2)nn1 |

TABLE 2C-continued
| Monomers | | | |
|---|---|---|---|
| # | Symbol/Name | Structure | Smiles |
| 326 | DMMMF | 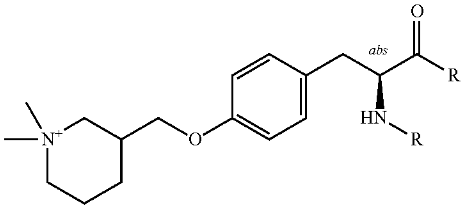 $C_{17}H_{25}N_2O_2R_2^+$ | C[N+]1(C)CC(COc2ccc(C[C@@H](C([R])=O)N[R])cc2)CCC1 |
| 327 | MMoEF | 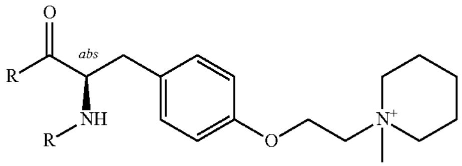 $C_{17}H_{25}N_2O_2R_2^+$ | C[N+]1(CCOc2ccc(C[C@@H](C([R])=O)N[R])cc2)CCCCC1 |
| 328 | MMoPF | 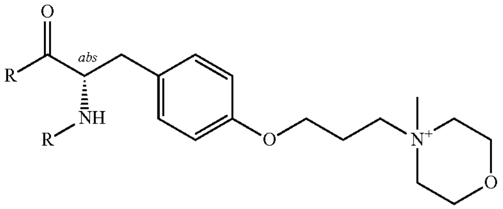 | C[N+]1(CCCOc2ccc(C[C@H](C([R])=O)N[R])cc2)CCOCC1 |
| 329 | AEF(MEP) | 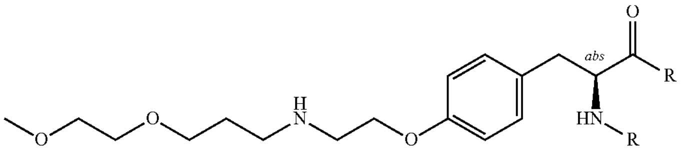 $C_{17}H_{25}N_2O_3R_2^+$ | COCCOCCCNCCOc1ccc(C[C@@H](C([R])=O)N[R])cc1 |

TABLE 2C-continued
| Monomers | | | |
|---|---|---|---|
| # | Symbol/Name | Structure | Smiles |
| 330 | 4DMPzEF | 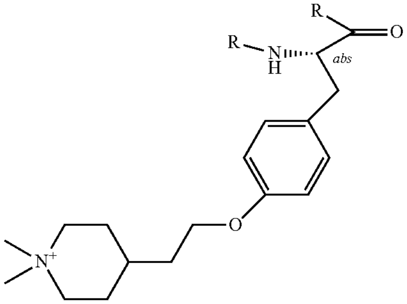 $C_{17}H_{26}N_2O_4R_2$ | C[N+]1(C)CCN(CCOc2ccc(C[C@@H](C([R])=O)N[R])cc2)CC1C[N+]1(C)CCN(CCOc2ccc(C[C@@H](C=O)N)cc2)CC1 |
| 331 | TMAPF | 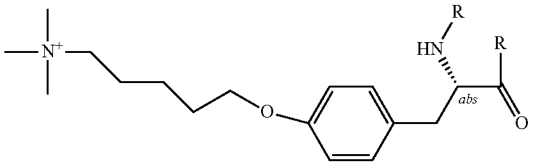 $C_{17}H_{26}N_3O_2R_2^+$ | C[N+](C)(C)CCCCCOc1ccc(C[C@@H](C([R])=O)N[R])cc1C[N+](C)(C)CCCCCOc1ccc(C[C@@H](C=O)N)cc1 |
| 332 | K(D), KCar | 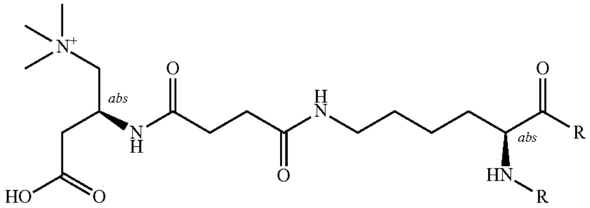 $C_{17}H_{31}N_4O_5R_2^+$ | C[N+](C)(C)C[C@H](CC(O)=O)NC(CCC(NCCCC[C@@H](C([R])=O)N[R])=O)=O |
| 333 | K(d), KdCar | 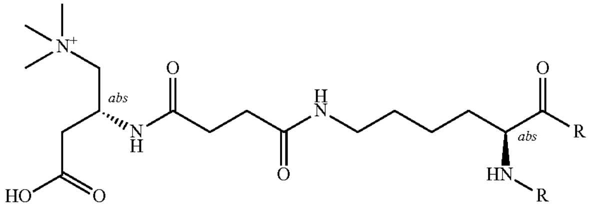 $C_{17}H_{31}N_4O_5R_2^+$ | C[N+](C)(C)C[C@@H](CC(O)=O)NC(CCC(NCCCC[C@@H](C([R])=O)N[R])=O)=O |

TABLE 2C-continued
| Monomers | | |
|---|---|---|
| # Symbol/Name | Structure | Smiles |
| 334 k(D), dKCar | 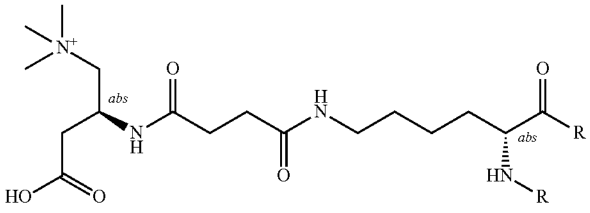 $C_{17}H_{31}N_4O_5R_2^+$ | C[N+](C)(C)C[C@H](CC(O)=O)NC(CCC(NCCCC[C@H](C([R])=O)N[R])=O)=O |
| 335 k(d), dKdCar | 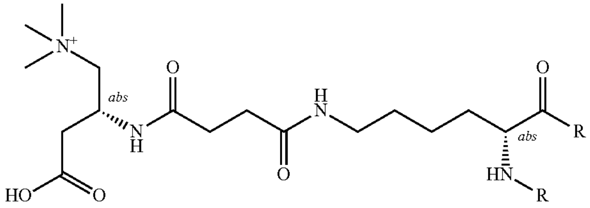 $C_{17}H_{31}N_4O_5R_2^+$ | C[N+](C)(C)C[C@@H](CC(O)=O)NC(CCC(NCCCC[C@H](C([R])=O)N[R])=O)=O |
| 336 7(3CF3TAZP)W | 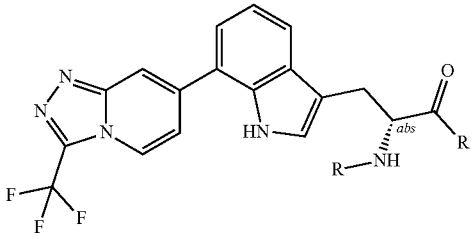 $C_{18}H_{12}F3N_5OR_2$ | O=C([C@H](Cc1c[nH]c2c1cccc2-c1cc2nnc(C(F)(F)F)n2cc1)N[R])[R] |

TABLE 2C-continued
| Monomers | | | |
|---|---|---|---|
| # | Symbol/Name | Structure | Smiles |
| 337 | 7(4OCF3Ph)W | 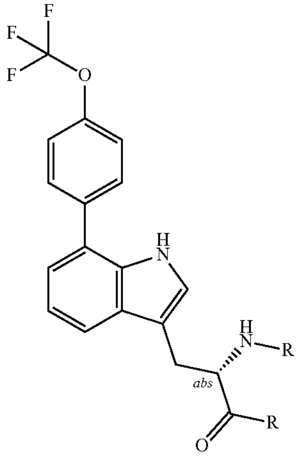 $C_{18}H_{13}F3N_2O_2R_2$ | O=C([C@H](Cc1c[nH]c2c1cccc2-c(cc1)ccc1OC(F)(F)F)N[R])[R] |
| 338 | 7(4CF3Ph)W | 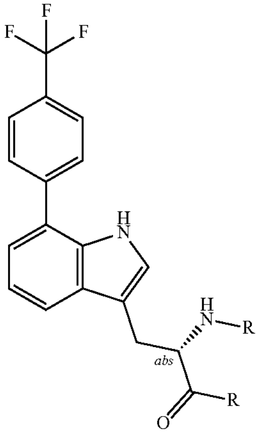 $C_{18}H_{13}F3N_2OR_2$ | O=C([C@H](Cc1c[nH]c2c1cccc2-c1ccc(C(F)(F)F)cc1)N[R])[R] |

TABLE 2C-continued
| Monomers | | |
|---|---|---|
| # Symbol/Name | Structure | Smiles |
| 339 7(7ImidPyr)W | 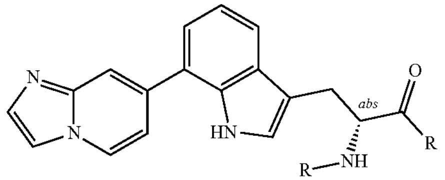<br>$C_{18}H_{14}N_4OR_2$ | O=C([C@H](Cc1c[nH]c2c1cccc2-c1cc2nccn2cc1)N[R])[R] |
| 340 Y($C_9$OH) | 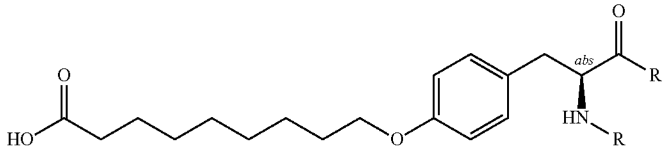<br>$C_{18}H_{25}NO_4R_2$ | OC(CCCCCCCCOc1ccc(C[C@@H](C([R])=O)N[R])cc1)=O |
| 341 Y(OTzlCh) | 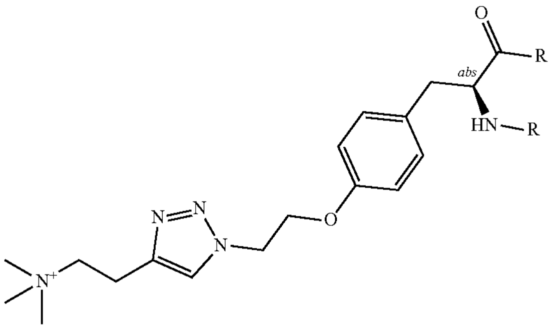<br>$C_{18}H_{26}N_5O_2R_2^+$ | C[N+](C)(C)CCc1cn(CCOc2ccc(C[C@@H](C([R])=O)N[R])cc2)nn1 |

TABLE 2C-continued
| # Symbol/Name | Structure | Smiles |
|---|---|---|
| Monomers | | |
| 342 4DMPEF | 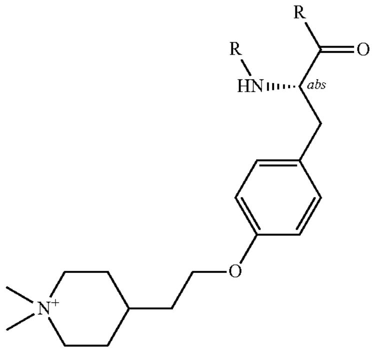 $C_{18}H_{27}N_2O_2R_2^+$ | C[N+]1(C)CCC(CCOc2ccc(C[C@@H](C([R])=O)N[R])cc2)CC1C[N+]1(C)CCC(CCOc2ccc(C[C@@H](C=O)N)cc2)CC1 |
| 343 AEF(AcCh) | 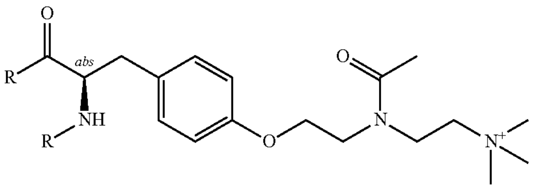 $C_{18}H_{28}N_3O_3R_2^+$ | CC(N(CC[N+](C)(C)C)CCOc1ccc(C[C@@H](C([R])=O)N[R])cc1)=O |
| 344 TMA6F | 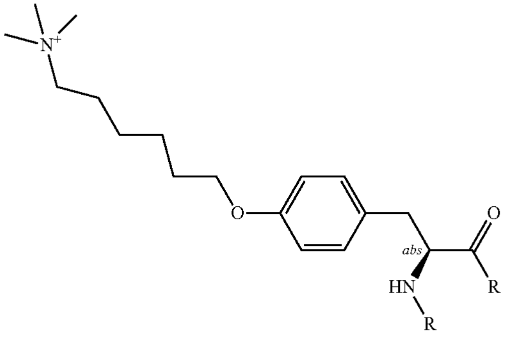 $C_{18}H_{29}N_2O_2R_2^+$ | C[N+](C)(C)CCCCCCOc1ccc(C[C@@H](C([R])=O)N[R])cc1 |

TABLE 2C-continued
| Monomers | | | |
|---|---|---|---|
| # | Symbol/Name | Structure | Smiles |
| 345 | AEF(MePrpa) | 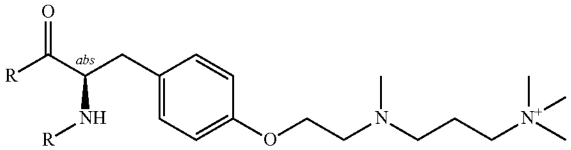 $C_{18}H_{30}N_3O_2R_2^+$ | CN(CCC[N+](C)(C)C)CCOc1ccc(C[C@@H](C([R])=O)N[R])cc1 |
| 346 | 2Nal6(PH$_2$OH) | 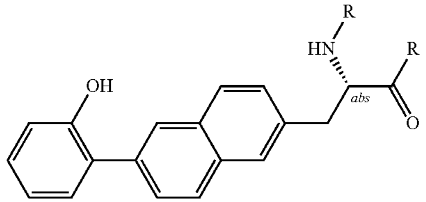 $C_{19}H_{15}NO_2R_2$ | Oc(cccc1)c1-c1ccc(cc(C[C@@H](C([R])=O)N[R])cc2)c2c1 |
| 347 | 7(3NAcPh)W | 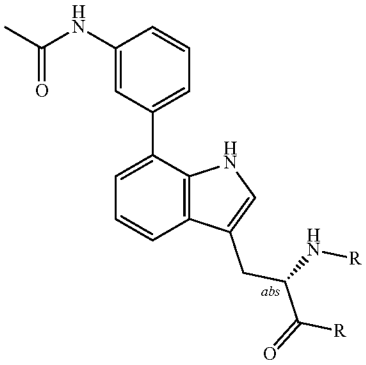 $C_{19}H_{17}N_3O_2R_2$ | CC(Nc1cccc(-c2cccc3c2[nH]cc3C[C@@H](C([R])=O)N[R])c1)=O |

TABLE 2C-continued
| Monomers | | |
|---|---|---|
| # Symbol/Name | Structure | Smiles |
| 348 7(4NAcPh)W | 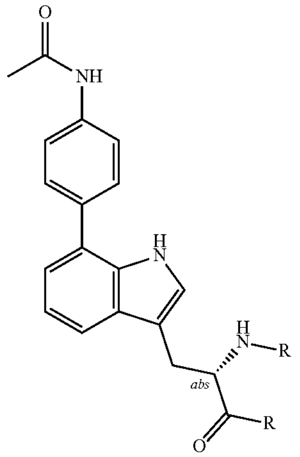 $C_{19}H_{17}N_3O_2R_2$ | CC(Nc(cc1)ccc1-c1cccc2c1[nH]cc2C[C@@H](C([R])=O)N[R])=O |
| 349 4PipPhe | 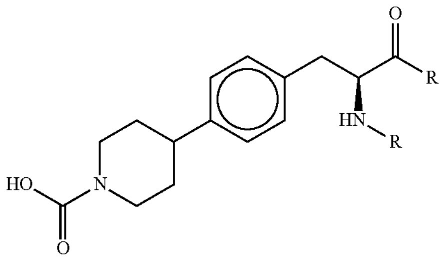 $C_{19}H_{26}N_2O_3R_2$ | CC(C)(C)OC(N(CC1)CCC1c1ccc(C[C@@H](C([R])=O)N[R])cc1)=O |

TABLE 2C-continued
| Monomers | | | |
|---|---|---|---|
| # | Symbol/Name | Structure | Smiles |
| 350 | a | 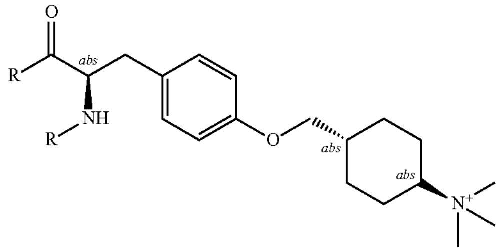<br>$C_{19}H_{29}N_2O_2R_2^+$ | C[N+](C)(C)[C@H]1CC[C@H](COc2ccc(C[C@@H](C([R])=O)N[R])cc2)CC1 |

TABLE 2D
| Peg Moeties and Peg Modified Monomers | | | |
|---|---|---|---|
| 1 | Structure | Names and Synonyms | Smiles Structure |
| 2 | 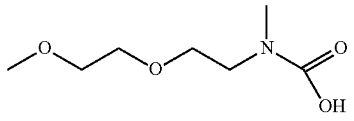<br>C7H15NO3<br>CON(MePEG2) | | CN(CCOCCOC)C=O |
| 3 | 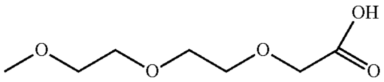<br>C7H14O4<br>mPEG3CO | | COCCOCCOCC=O |
| 4 | 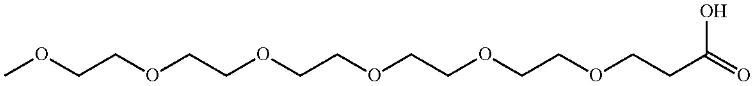 [SMILES: COCCOCCOCCOCCOCCOCCC(=O)O]<br>C14H28O7<br>mPEG6CO | | COCCOCCOCCOCCOCCOCCC=O |
| 5 | 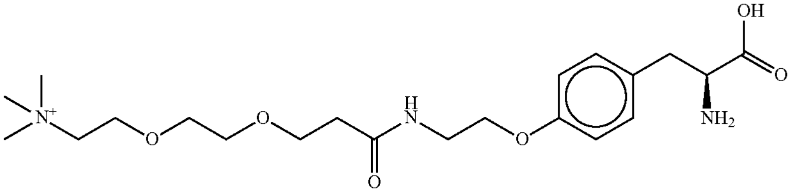<br>C21H36N3O5+<br>AEFNMePEG3a, AEF(NHcPEG3a) | | C[N+](C)(C)CCOCCOCCC(NCCOc1ccc(C[C@@H](C=O)N)cc1)=O |
| 6 | 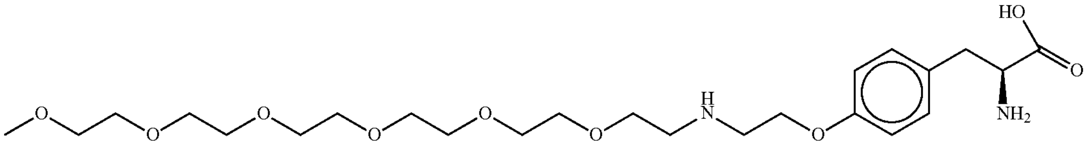 | | COCCOCCOCCOCCOCCOCCNCCOc1ccc(C[C@@H](C=O)N)cc1 |

TABLE 2D-continued

| Peg Moeties and Peg Modified Monomers | | | |
|---|---|---|---|
| 1 | Structure | Names and Synonyms | Smiles Structure |
| | C24H42N2O8<br>AEFNmPEG6, AEF(NmPEG6) | | |
| 7 | 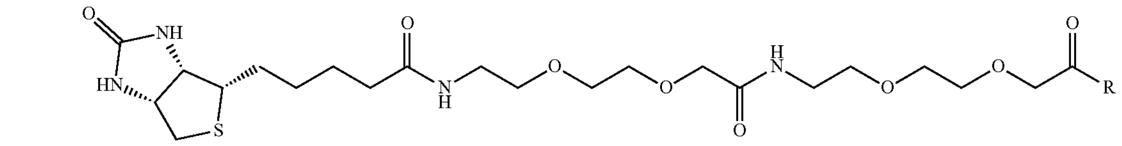<br>C22H37N4O8SR<br>BiotinPEG2PEG2, Biotin(PEG2PEG2) | | O=C(CCCC[C@@H]([C@H]1N2)SC[C@@H]1NC2=O)NCCOCCOCC(NCCOCCOCC([R])=O)=O |
| 8 | 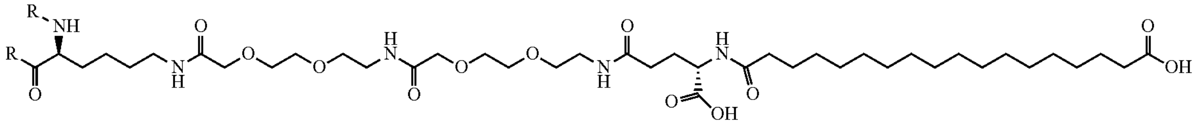<br>C41H73N5O13R2<br>K(PEG2PEG2gEC18OH) | | OC(CCCCCCCCCCCCCCCCC(N[C@@H](CCC(NCCOCCOCC(NCCOCCOCC(NCCCC[C@@H](C([R])=O)N[R])=O)=O)=O)C(O)=O)=O)=O |
| 9 | 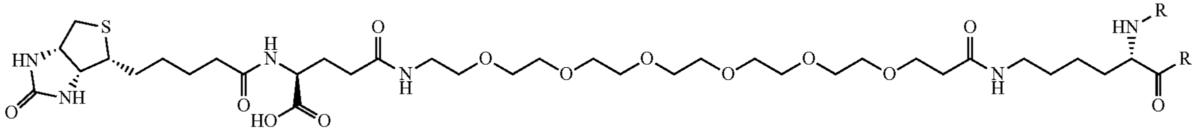<br>C36H62N6O13SR2<br>K(PEG6gEBiotin) | | OC([C@H](CCC(NCCOCCOCCOCCOCCOCCOCCC(NCCCC[C@@H](C([R])=O)N[R])=O)=O)NC(CCCC[C@H]([C@@H]1N2)SC[C@H]1NC2=O)=O)=O |
| 10 | 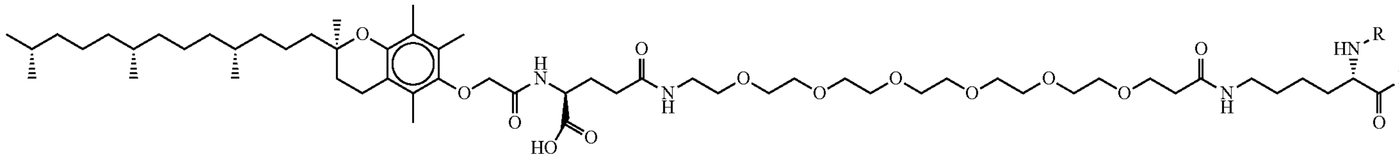<br>C57H98N4O14R2<br>K(PEG6gEVitE) | | CC(C)CCC[C@@H](C)CCC[C@@H](C)CCC[C@](C)(CC1)Oc(c(C)c2C)c1c(C)c2OCC(N[C@@H](CCC(NCCOCCOCCOCCOCCOCCOCCC(NCCCC[C@@H](C([R])=O)N[R])=O)=O)C(O)=O)=O |

TABLE 2D-continued
Peg Moeties and Peg Modified Monomers
| 1 | Structure | Names and Synonyms | Smiles Structure |
|---|---|---|---|
| 11 | 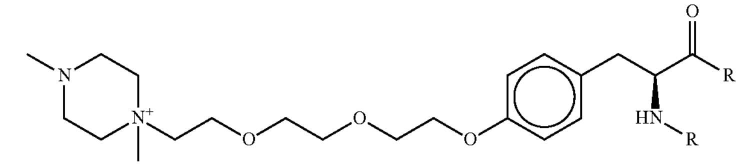<br>C21H34N3O4R2+<br>MPzPEG3F | | CN1CC[N+](C)(CCOCCOCCOc2ccc(C[C@@H](C([R])=O)N[R])cc2)CC1 |
| 12 | 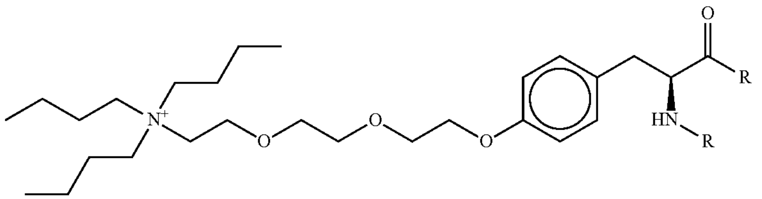<br>C27H47N2O4R2+<br>TBAPEG3F | | CCCC[N+](CCCC)(CCCC)CCOCCOCCOc1ccc(C[C@@H](C([R])=O)N[R])cc1 |
| 13 | 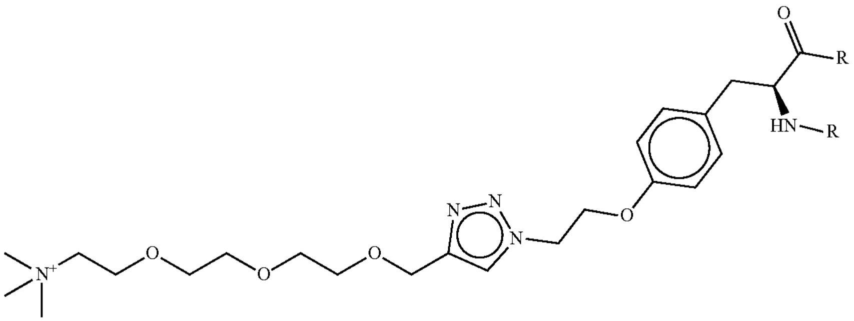<br>C23H36N5O5R2+<br>Y(OTzlPEG3a) | | C[N+](C)(C)CCOCCOCCOCc1cn(CCOc2ccc(C[C@@H](C([R])=O)N[R])cc2)nn1 |

TABLE 2D-continued

| Peg Moeties and Peg Modified Monomers | | | |
|---|---|---|---|
| 1 | Structure | Names and Synonyms | Smiles Structure |
| 14 | 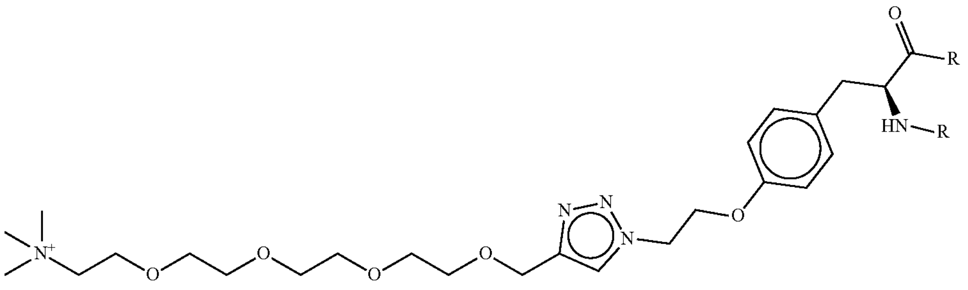<br>C25H40N5O6R2+<br>Y(OTzlPEG4a) | | C[N+](C)(C)CCOCCOCCOCCOCc1cn(CCOc2ccc(C[C@@H](C([R])=O)N[R])cc2)nn1 |
| 15 | 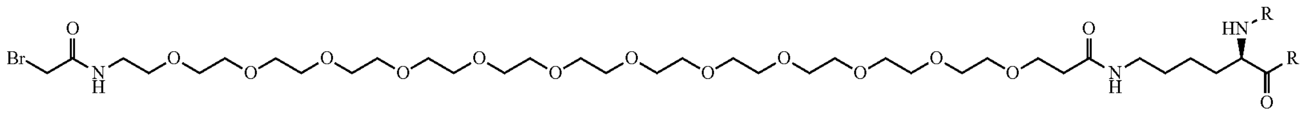<br>C35H66BrN3O15R2<br>k(PEG6Biotin), dK(PEG6Biotin) | | O=C(CCOCCOCCOCCOCCOCCOCCOCCOCCOCCOCCOCCOCCNC(CBr)=O)NCCCC[C@H](C([R])=O)N[R] |
| 16 | 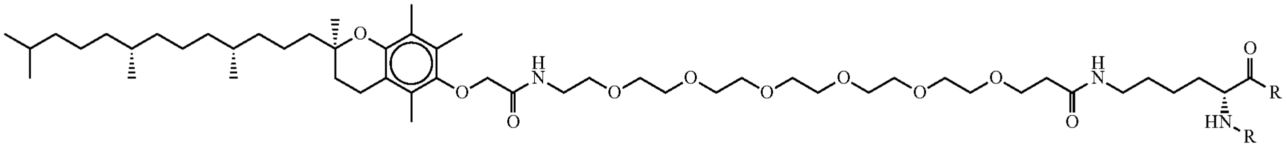<br>C52H91N3O11R2<br>k(dPEG12Ac), dK(dPEG12Ac) | | CC(C)CCC[C@@H](C)CCC[C@@H](C)CCC[C@](C)(CC1)Oc(c(C)c2C)c1c(C)c2OCC(NCCOCCOCCOCCOCCOCCOCCOCC(NCCCC[C@H](C([R])=O)N[R])=O)=O |
| 17 | 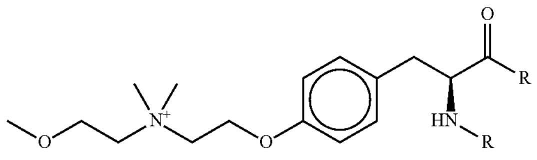<br>C16H25N2O3R2+<br>mPEG2TMA2F | | C[N+](C)(CCOC)CCOc1ccc(C[C@@H](C([R])=O)N[R])cc1 |

TABLE 2D-continued
| Peg Moeties and Peg Modified Monomers | | | |
|---|---|---|---|
| 1 | Structure | Names and Synonyms | Smiles Structure |
| 18 | 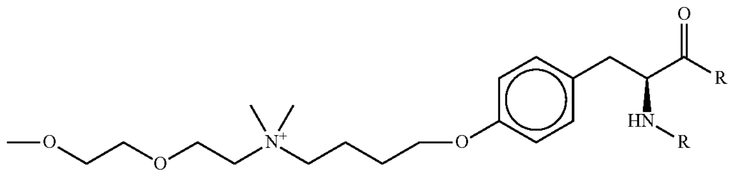<br>C20H33N2O4R2+<br>mPEG3TMA4F | | C[N+](C)(CCCCOc1ccc(C[C@@H](C([R])=O)N[R])cc1)CCOCCOC |
| 19 | 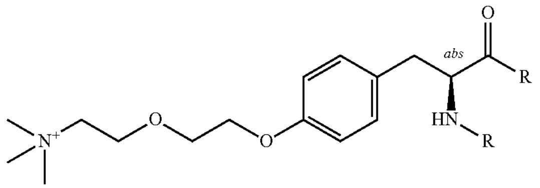<br>C16H25N2O3R2+ | | C[N+](C)(C)CCOCCOc1ccc(C[C@@H](C([R])=O)N[R])cc1 |
| 20 | 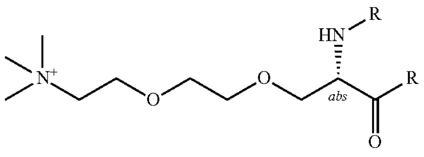<br>C10H21N2O3R2+ | | C[N+](C)(C)CCOCCOC[C@@H](C([R])=O)N[R] |
| 21 | 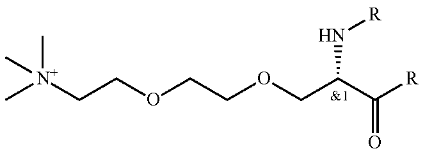<br>C10H21N2O3R2+ | | C[N+](C)(C)CCOCCOCC(C([R])=O)N[R] |

TABLE 2D-continued
| Peg Moeties and Peg Modified Monomers | | | |
|---|---|---|---|
| 1 | Structure | Names and Synonyms | Smiles Structure |
| 22 | 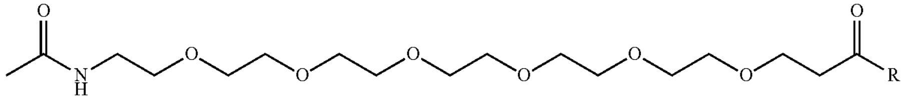<br>C17H32NO8R | CC(NCCOCCOCCOCCOCCOCCOCCC([R])=O)=O | |
| 23 | 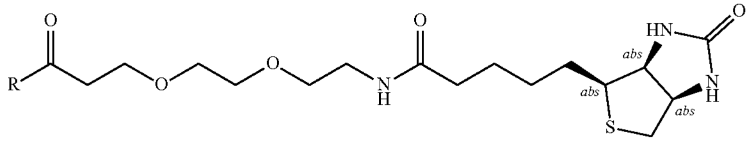<br>C17H28N3O5SR | O=C(CCCC[C@@H]([C@H]1N2)SC[C@@H]1NC2=O)NCCOCCOCCC([R])=O | |
| 24 | 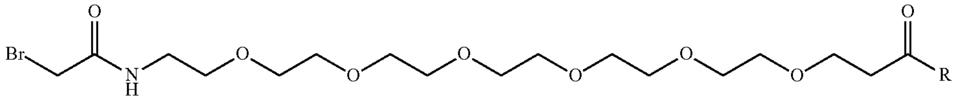<br>C17H31BrNO8R | O=C(CBr)NCCOCCOCCOCCOCCOCCOCCC([R])=O | |
| 25 | 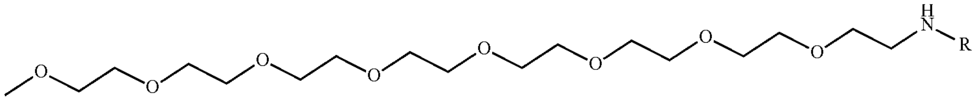<br>C17H36NO8R | COCCOCCOCCOCCOCCOCCOCCOCCN[R] | |
| 26 | 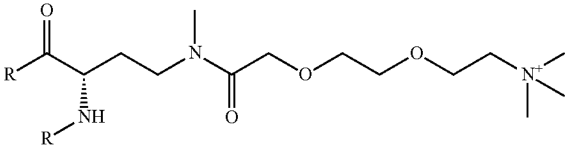<br>C14H28N3O4R2+ | CN(CC[C@@H](C([R])=O)N[R])C(COCCOCC[N+](C)(C)C)=O | |

TABLE 2D-continued
| Peg Moeties and Peg Modified Monomers | | | |
|---|---|---|---|
| 1 | Structure | Names and Synonyms | Smiles Structure |
| 27 | 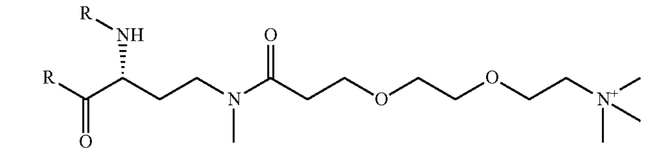 C15H30N3O4R2+ | | CN(CC[C@@H](C([R])=O) N[R])C(CCOCCOCC[N+] (C)(C)C)=O |
| 28 | 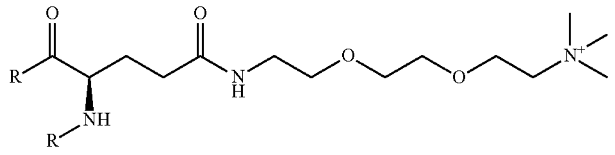 C14H28N3O4R2+ | | C[N+](C)(C)CCOCCOCC NC(CC[C@@H](C([R])=O) N[R])=O |
| 29 | 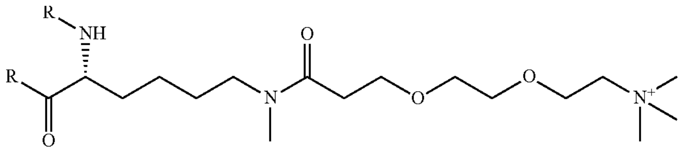 C17H34N3O4R2+ | | CN(CCCC[C@@H](C([R])= O)N[R])C(CCOCCOCC [N+](C)(C)C)=O |
| 30 | 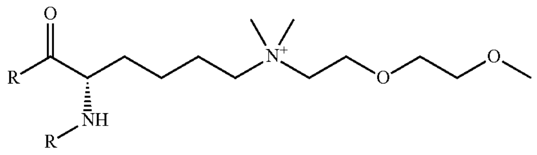 C13H27N2O3R2+ | | C[N+](C)(CCCC[C@@H] (C([R])=O)N[R])CCOCCOC |
| 31 | 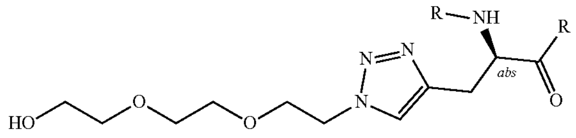 C11H18N4O4R2 | | OCCOCCOCCn1nnc(C [C@@H](C([R])=O)N[R])c1 |

TABLE 2D-continued
| Peg Moeties and Peg Modified Monomers | | | |
|---|---|---|---|
| 1 | Structure | Names and Synonyms | Smiles Structure |
| 32 | 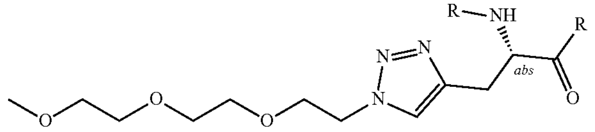 C12H20N4O4R2 | | COCCOCCOCCn1nnc(C [C@@H](C([R])=O)N[R])c1 |
| 33 | 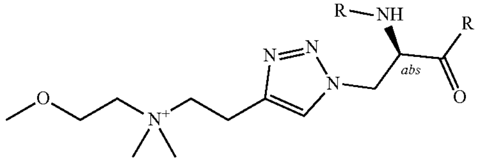 C12H22N5O2R2+ | | C[N+](C)(CCc1cn(C[C@ @H](C([R])=O)N[R])nn1) CCOC |
| 34 | 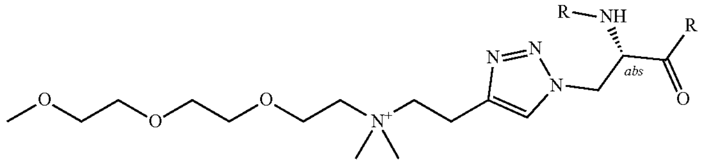 C16H30N5O4R2+ | | C[N+](C)(CCc1cn(C[C@@H] (C([R])=O)N[R])nn1) CCOCCOCCOC |
| 35 | 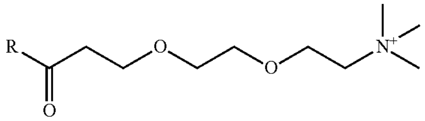 C10H21NO3R+ | | C[N+](C)(C)CCOCCOCC C([R])=O |
| 36 | 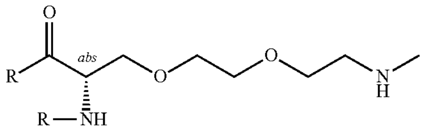 C8H16N2O3R2 | | CNCCOCCOC[C@H](C ([R])=O)N[R] |

TABLE 2D-continued
| Peg Moeties and Peg Modified Monomers | | | |
|---|---|---|---|
| 1 | Structure | Names and Synonyms | Smiles Structure |
| 37 | 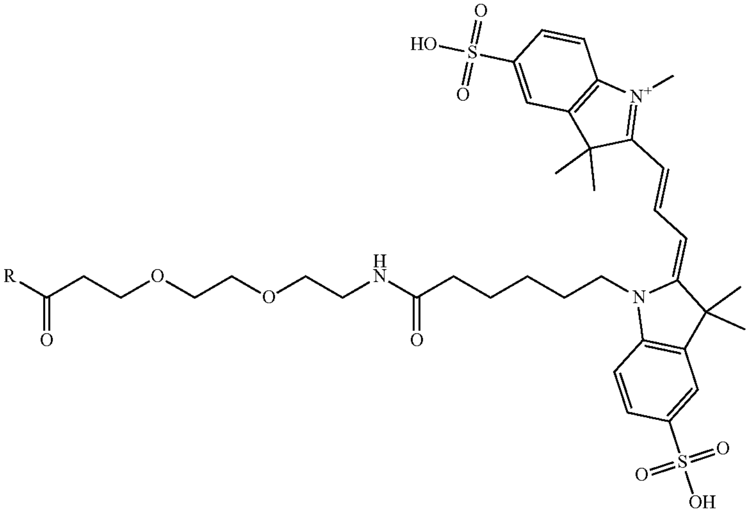<br>C37H49N3O10S2R+ (SulfoCy3dPEG2)<br>CC1(C)c(cc(cc2)S(O)(=O)=O)c2[N+](C)=C1/C=C/C=C(/C1(C)C)\N(CCCCCC(NCCOCCOCCC ([R])=O)=O)c(cc2)c1cc2S(O)(=O)=O | | |

TABLE 2D-continued

| Peg Moeties and Peg Modified Monomers | | | |
|---|---|---|---|
| 1 | Structure | Names and Synonyms | Smiles Structure |
| 38 | 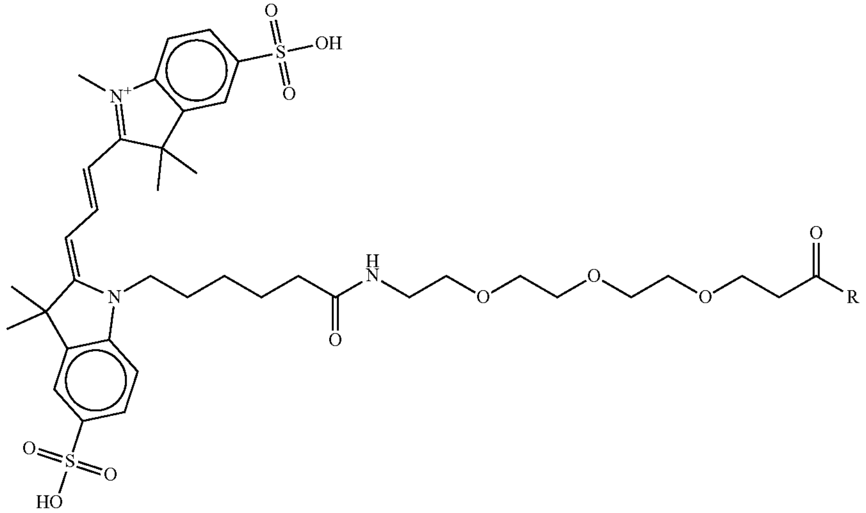<br>C39H53N3O11S2R+ (SulfoCy3dPEG3)<br>CC1(C)c(cc(cc2)S(O)(=O)=O)c2[N+](C)=C1/C=C/C=C(/C1(C)C)\N(CCCCCC(NCCOCCOCCO CCC([R])=O)=O)c(cc2)c1cc2S(O)(=O)=O | | |
| 39 | 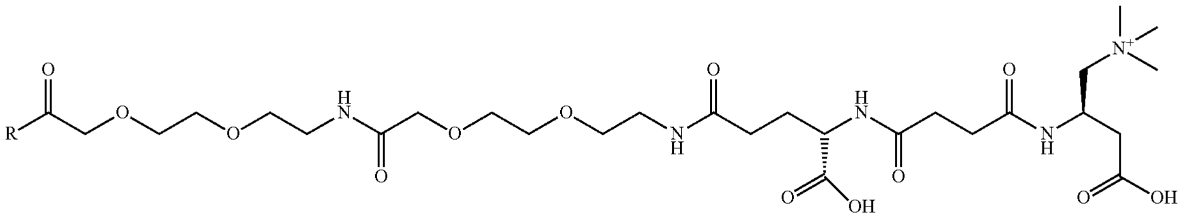<br>C28H49N5O13R+ (d)gEPEG2PEG2 | | C[N+](C)(C)C[C@@H](CC(O)=O)NC (CCC(N[C@@H](CCC(NCCOCCOCC (NCCOCCOCC([R])=O)=O)=O) C(O)=O)=O)=O |
| 40 | 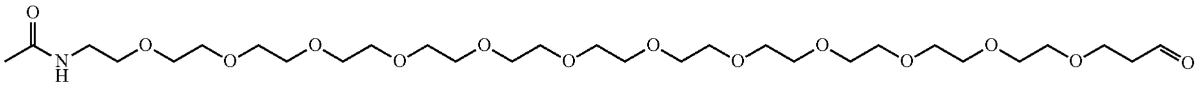 [SMILES: CC(=O)NCCOCCOCCOCCOCCOCCOCCOCCOCCOCCOCCOCCOCCC=O]<br>C29H57NO14 AcdPEG12CO | | CC(NCCOCCOCCOCCOCCOCCO CCOCCOCCOCCOCCOCCOCCC= O)=O |

TABLE 2D-continued

| Peg Moeties and Peg Modified Monomers | | | |
|---|---|---|---|
| 1 | Structure | Names and Synonyms | Smiles Structure |
| 41 | 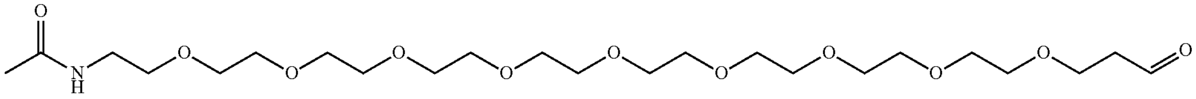 [SMILES: CC(=O)NCCOCCOCCOCCOCCOCCOCCOCCOCCOCCC=O]<br>C23H45NO11 AcdPEG9CO | | CC(NCCOCCOCCOCCOCCOCCO CCOCCOCCOCCC=O)=O |
| 42 | 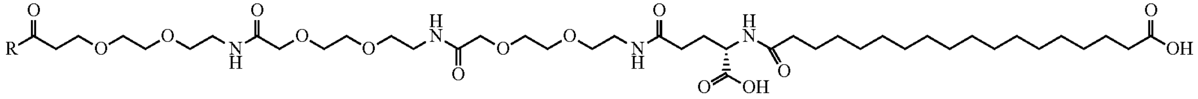<br>C42H75N4O15R<br>AEEP(PEG2PEG2gEC18OH) | | OC(CCCCCCCCCCCCCCCCC(N [C@@H](CCC(NCCOCCOCC (NCCOCCOCC(NCCOCCOCCC ([R])=O)=O)=O)=O)C(O)=O)=O)=O |
| 43 | 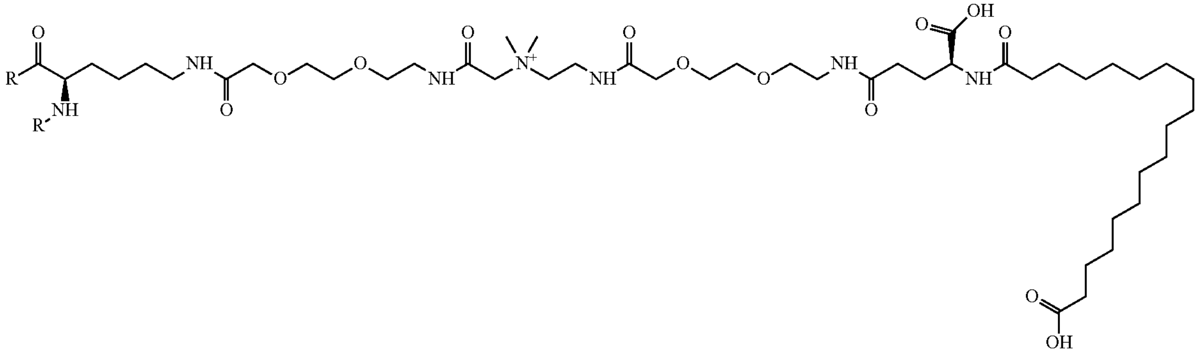<br>C47H86N7O14R2+<br>AEEPPEG2PEG2gEC18OH,<br>k(PEG2Sp6PEG2gEC18OH),<br>dK(PEG2Sp6PEG2gEC18OH) | | C[N+](C)(CCNC(COCCOCCNC(CC [C@@H](C(O)=O)NC(CCCCCCCC CCCCCCCCC(O)=O)=O)=O)=O)CC (NCCOCCOCC(NCCCC[C@H](C ([R])=O)N[R])=O)=O |

TABLE 2D-continued

| Peg Moeties and Peg Modified Monomers | | | |
|---|---|---|---|
| 1 | Structure | Names and Synonyms | Smiles Structure |
| 44 | 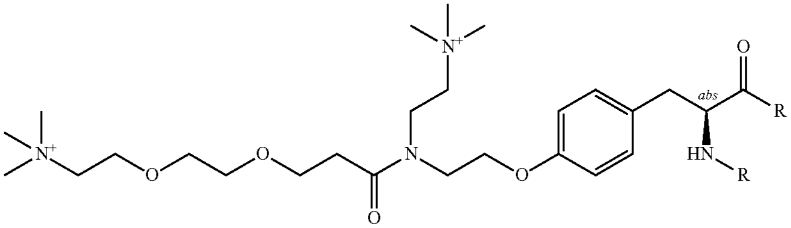 C26H46N4O5R2 + 2 AEF((Ch)cPEG3a) | | C[N+](C)(C)CCN(CCOc1ccc(C [C@@H](C([R])=O)N[R])cc1)C (CCOCCOCC[N+](C)(C)C)=O |
| 45 | 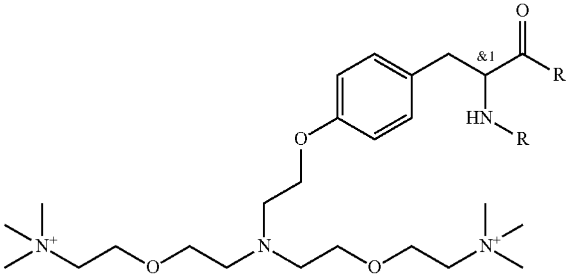 C25H46N4O4R2 + 2 AEF(BisPEG2a)(RS) AEF(BisPEG2a)(S*) (The RS and the S* indicates the stereochemistry) | | C[N+](C)(C)CCOCCN(CCOCC[N+] (C)(C)C)CCOc1ccc(CC(C([R])=O) N[R])cc1 |
| 46 | 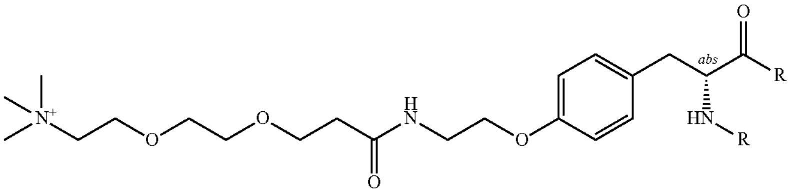 C21H34N3O5R2+ AEF(NMePEG3a), AEF(NMecPEG3aCO) | | C[N+](C)(C)CCOCCOCCC(NCCO c1ccc(C[C@@H](C([R])=O) N[R])cc1)=O |

TABLE 2D-continued
| Peg Moeties and Peg Modified Monomers | | | |
|---|---|---|---|
| 1 | Structure | Names and Synonyms | Smiles Structure |
| 47 | 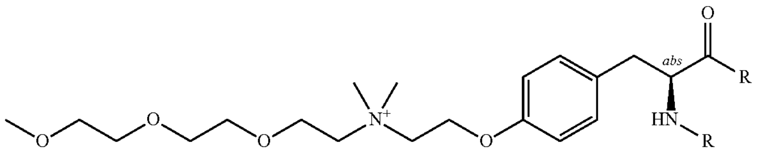 C20H33N2O5R2+ AEF(NMe2mPEG3) | | C[N+](C)(CCOCCOCCOC)CCO c1ccc(C[C@@H](C([R])=O) N[R])cc1 |
| 48 | 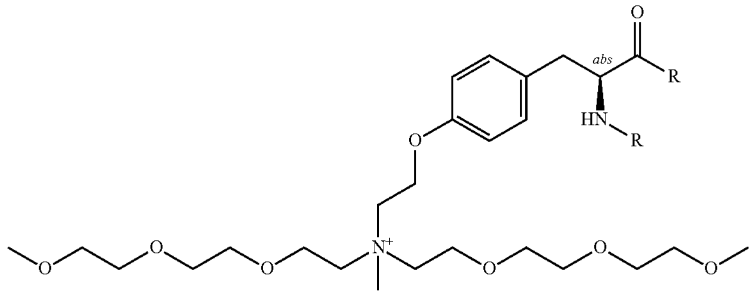 C26H45N2O8R2+ AEF(NMeBismPEG3) | | C[N+](CCOCCOCCOC) (CCOCCOCCOC)CCOc1ccc (C[C@@H](C([R])=O)N[R])cc1 |
| 49 | 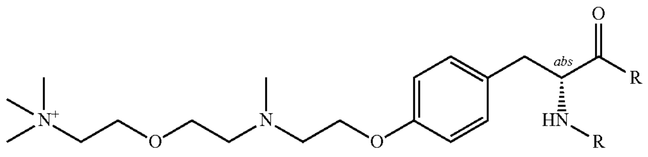 C19H32N3O3R2+ AEF(NMePEG2a) | | CN(CCOCC[N+](C)(C)C)CCOc1ccc (C[C@H](C([R])=O)N[R])cc1 |

TABLE 2D-continued

| Peg Moeties and Peg Modified Monomers | | | |
|---|---|---|---|
| 1 | Structure | Names and Synonyms | Smiles Structure |
| 50 | 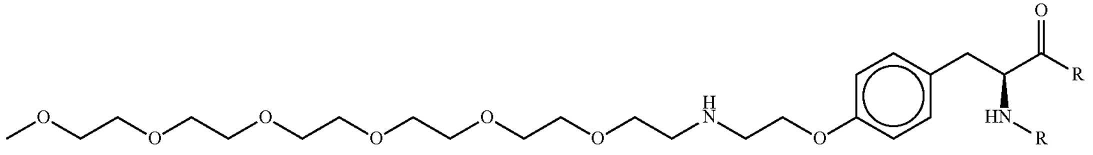<br>C24H40N2O8R2<br>AEF(NmPEG6) | | COCCOCCOCCOCCOCCOCCNCCO c1ccc(C[C@@H](C([R])=O)N[R])cc1 |
| 51 | 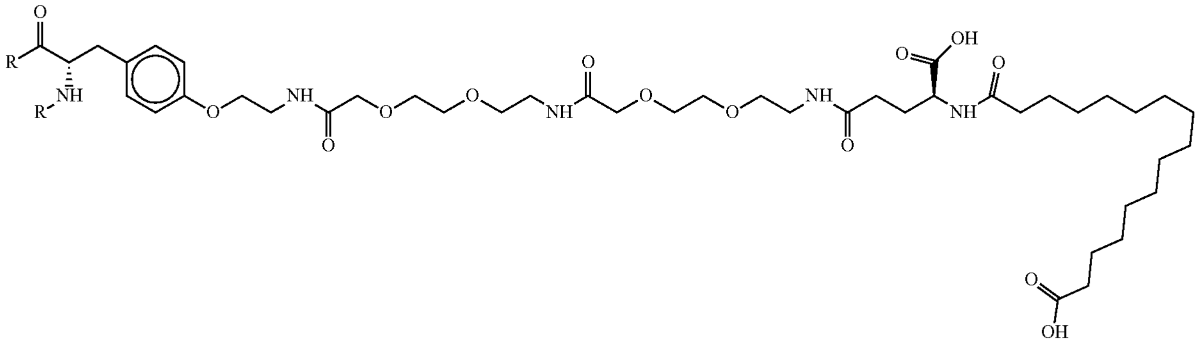<br>C44H71N5O14R2<br>AEF(PEG2PEG2gEC16OH) | | OC(CCCCCCCCCCCCCCC(N [C@@H](CCC(NCCOCCOCC (NCCOCCOCC(NCCOc1ccc (C[C@@H](C([R])=O)N[R]) cc1)=O)=O)=O)C(O)=O)=O)=O |
| 52 | 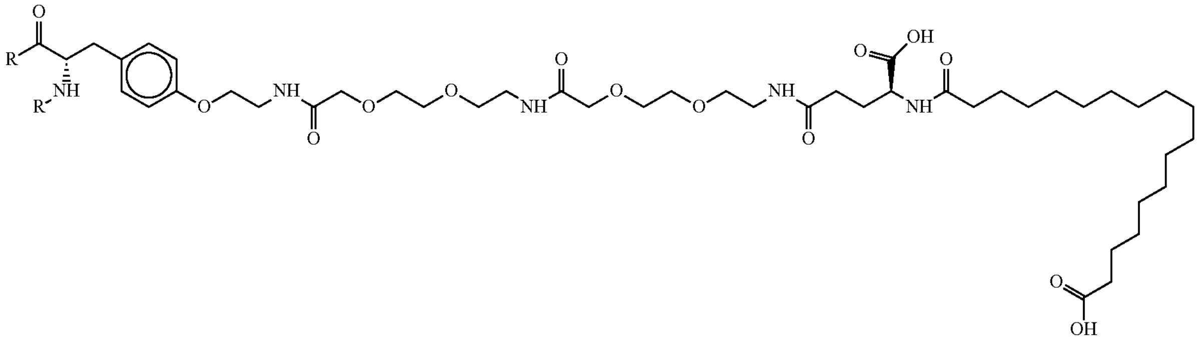 | | OC(CCCCCCCCCCCCCCCCC(N [C@@H](CCC(NCCOCCOCC (NCCOCCOCC(NCCOc1ccc(C [C@@H](C([R])=O)N[R]) cc1)=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| | C46H75N5O14R2<br>AEF(PEG2PEG2gEC18OH) | | |
| 53 | 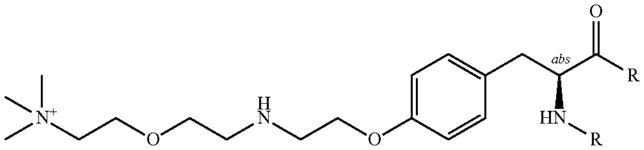<br>C18H30N3O3R2+<br>AEF(Peg2a), AEF(PEG2a) | | C[N+](C)(C)CCOCCNCCOc1ccc(C[C@@H](C([R])=O)N[R])cc1 |
| 54 | 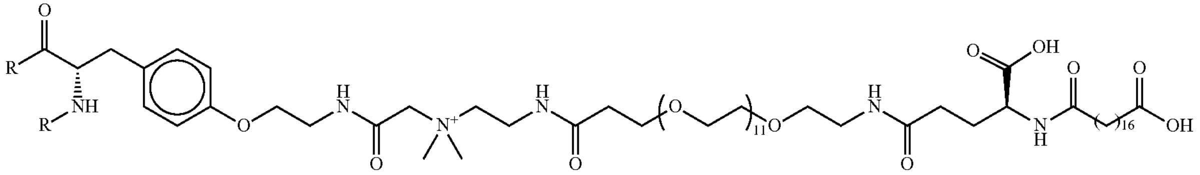<br>C67H119N6O22R2+<br>AEF(SP6PEG12gEC18OH) | | C[N+](C)(CCNC(CCOCCOCCOCCOCCOCCOCCOCCOCCOCCOCCOCCOCCNC(CC[C@@H](C(O)=O)NC(CCCCCCCCCCCCCCCCC(O)=O)=O)=O)=O)CC(NCCOc1ccc(C[C@@H](C([R])=O)N[R])cc1)=O |
| 55 | 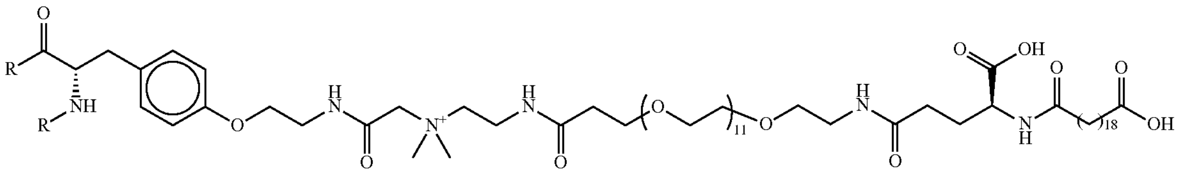<br>C69H123N6O22R2+<br>AEF(SP6PEG12gEC20OH) | | C[N+](C)(CCNC(CCOCCOCCOCCOCCOCCOCCOCCOCCOCCOCCOCCOCCNC(CC[C@@H](C(O)=O)NC(CCCCCCCCCCCCCCCCCCC(O)=O)=O)=O)=O)CC(NCCOc1ccc(C[C@@H](C([R])=O)N[R])cc1)=O |
| 56 | 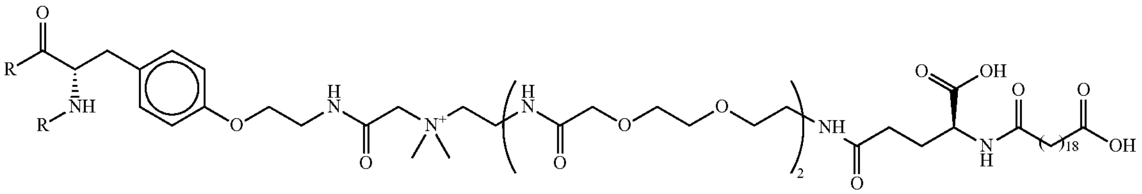 | | C[N+](C)(CCNC(COCCOCCNC(COCCOCCNC(CC[C@@H](C(O)=O)NC(CCCCCCCCCCCCCCCCCC(O)=O)=O)=O)=O)=O)CC(NCCOc1ccc(C[C@@H](C([R])=O)N[R])cc1)=O |

TABLE 2D-continued

| Peg Moeties and Peg Modified Monomers | | | |
|---|---|---|---|
| 1 | Structure | Names and Synonyms | Smiles Structure |
| | C52H88N7O15R2+ AEF(SP6PEG2PEG2gEC18OH) | | |
| 57 | 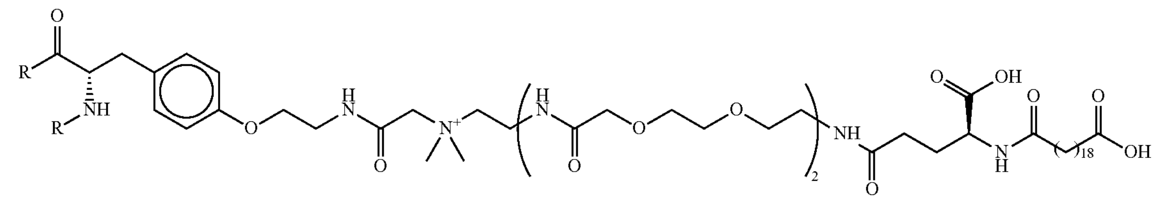 | | C[N+](C)(CCNC(COCCOCCNC(COCCOCCNC(CC[C@@H](C(O)=O)NC(CCCCCCCCCCCCCCCCCCCC(O)=O)=O)=O)=O)=O)CC(NCCOc1ccc(C[C@@H](C[R]=O)N[R]cc1)=O |
| | C54H92N7O15R2+ AEF(SP6PEG2PEG2gEC20OH) | | |
| 58 | 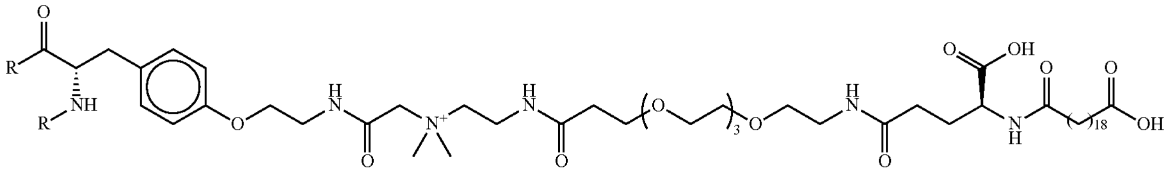 | | C[N+](C)(CCNC(CCOCCOCCOCCOCCOCCOCCNC(CC[C@@H](C(O)=O)NC(CCCCCCCCCCCCCCCCCC(O)=O)=O)=O)=O)CC(NCCOclccc(C[C@@H](C[R]=O)N[R]cc1)=O |
| | C55H95N6O16R2+ AEF(SP6PEG6gEC18OH) | | |
| 59 | 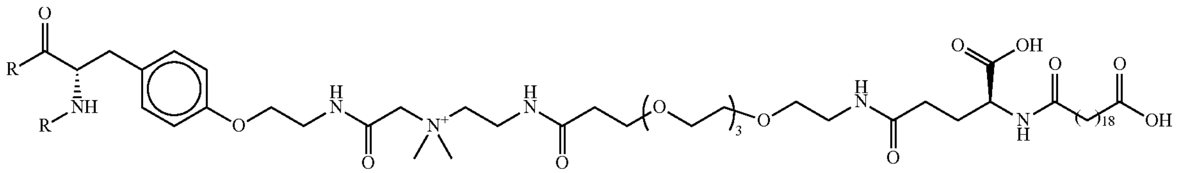 | | C[N+](C)(CCNC(CCOCCOCCOCCOCCOCCOCCNC(CC[C@@H](C(O)=O)NC(CCCCCCCCCCCCCCCCCCC(O)=O)=O)=O)=O)CC(NCCOc1ccc(C[C@@H](C([R])=O)N[R])cc1)=O |
| | C57H99N6O16R2+ AEF(SP6PEG6gEC20OH) | | |
| 60 | 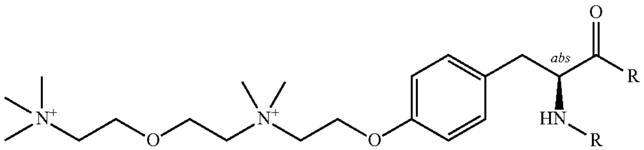 | | C[N+](C)(C)CCOCC[N+](C)(C)CCOc1ccc(C[C@@H](C([R])=O)N[R])cc1 |

TABLE 2D-continued

| Peg Moeties and Peg Modified Monomers | | | |
|---|---|---|---|
| 1 | Structure | Names and Synonyms | Smiles Structure |
| | C20H35N3O3R2+2<br>AEF(aPEG2a) | | |
| 61 | 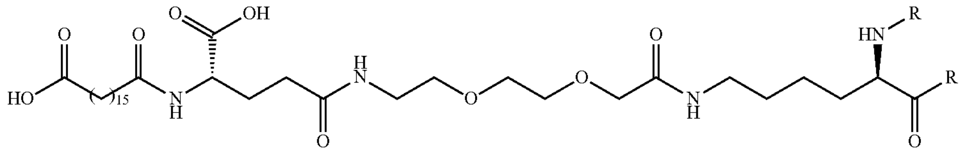 | | OC(CCCCCCCCCCCCCCCCC(N[C@@H](CCC(NCCOCCOCC(NCCCC[C@H](C([R])=O)N[R])=O)=O)C(O)=O)=O)=O |
| | C35H62N4O10R2<br>k(PEG2gEC18OH), d K(PEG2gEC18OH) | | |
| 62 | 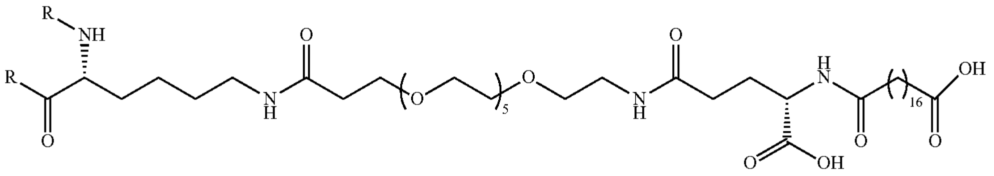 | | OC(CCCCCCCCCCCCCCCCC(N[C@@H](CCC(NCCOCCOCCOCCOCCOCCOCCOCCC(NCCCC[C@H](C([R])=O)N[R])=O)=O)C(O)=O)=O)=O |
| | C44H80N4O14R2<br>k(PEG6gEC18OH), d K(PEG6gEC18OH) | | |
| 63 | 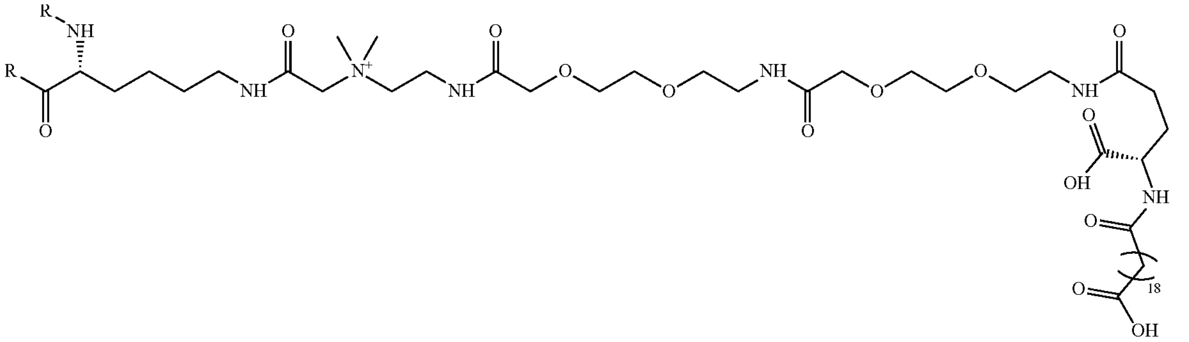 | | C[N+](C)(CCNC(COCCOCCNC(COCCOCCNC(CC[C@@H](C(O)=O)NC(CCCCCCCCCCCCCCCCCC(O)=O)=O)=O)=O)=O)CC(NCCCC[C@H](C([R])=O)N[R])=O |
| | C47H86N7O14R2+<br>k(Sp6PEG2PEG2gEC18OH),<br>dK(Sp6PEG2PEG2gEC18OH) | | |

TABLE 2D-continued
Peg Moeties and Peg Modified Monomers
| 1 | Structure | Names and Synonyms | Smiles Structure |
|---|---|---|---|
| 64 | 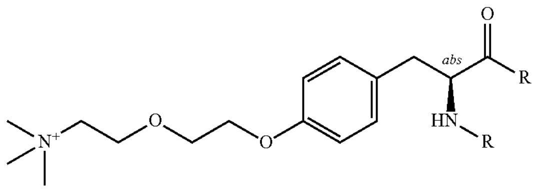<br>C16H25N2O3R2+<br>APEG2F | | C[N+](C)(C)CCOCCOc1ccc(C [C@@H](C([R])=O)N[R])cc1 |
| 65 | 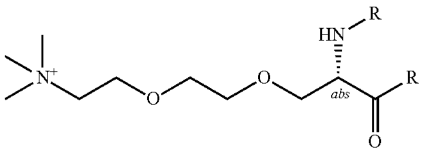<br>C10H21N2O3R2+<br>APEG2ser | | C[N+](C)(C)CCOCCOC[C@@H] (C([R])=O)N[R] |
| 66 | 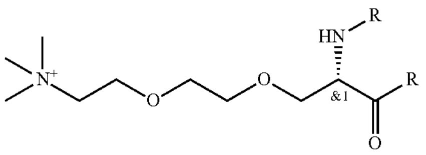<br>C10H21N2O3R2+<br>APEG2Ser(R*)<br>APEG2Ser(S*) | | C[N+](C)(C)CCOCCOCC(C ([R])=O)N[R] |
| 67 | 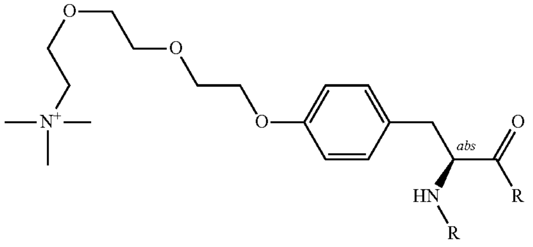 | | C[N+](C)(C)CCOCCOCCOc1ccc(C [C@@H](C([R])=O)N[R])cc1<br>C[N+](C)(C)CCOCCOCCOc1ccc(C [C@@H](C=O)N)cc1 |

TABLE 2D-continued

| Peg Moeties and Peg Modified Monomers | | | |
|---|---|---|---|
| 1 | Structure | Names and Synonyms | Smiles Structure |
| 68 | C18H29N2O4R2+<br>APEG3F<br>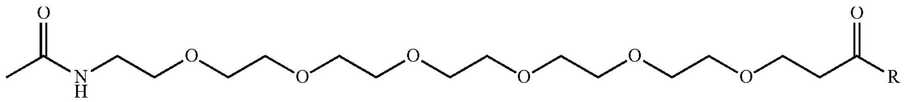 | | CC(NCCOCCOCCOCCOCCOCCO CCC([R])=O)=O |
| 69 | C17H32NO8R<br>AcdPEG6CO<br>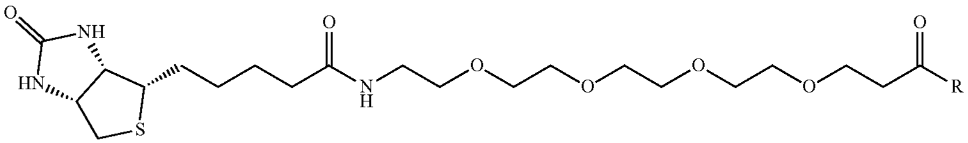 | | O=C(CCCC[C@@H]([C@H]1N2)SC [C@@H]1NC2=O)NCCOCCO CCOCCOCCC([R])=O |
| 70 | C21H36N3O7SR<br>BiotinPEG4CO, Biotin(PEG4CO), Biotin(PEG4)<br>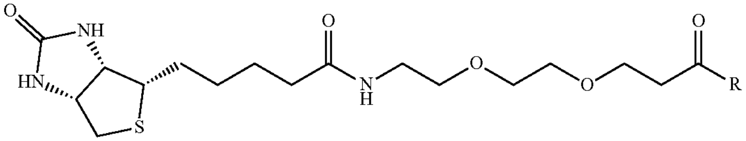 | | O=C(CCCC[C@@H]([C@H]1N2)SC [C@@H]1NC2=O)NCCOCCOCCC ([R])=O |
| 71 | Biotinyl(dPEG2), Biotin(dPEG2)<br>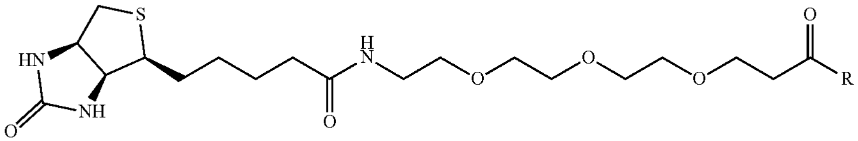 | | O=C(CCCC[C@@H]([C@H]1N2)SC [C@@H]1NC2=O)NCCOCCO CCOCCC([R])=O |
| 72 | C19H32N3O6SR<br>Biotinyl(dPEG3), Biotin(dPEG3)<br>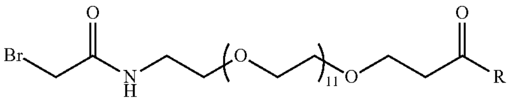 | | O=C(CBr)NCCOCCOCCOCCO CCOCCOCCOCCOCCOCCOCCO CCOCCC([R])=O |

TABLE 2D-continued

| Peg Moeties and Peg Modified Monomers | | | |
|---|---|---|---|
| 1 | Structure | Names and Synonyms | Smiles Structure |
| | C29H55BrNO14R<br>BrAcdPEG12CO | | |
| 73 | 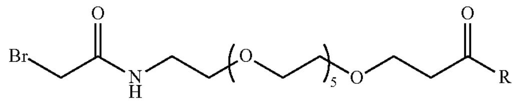 | | O=C(CBr)NCCOCCOCCOCCOCCO<br>CCOCCC([R])=O |
| | C17H31BrNO8R<br>BrAcdPEG6CO | | |
| 74 | 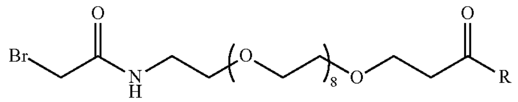 | | O=C(CBr)NCCOCCOCCOCCOCCO<br>CCOCCOCCOCCOCCC([R])=O |
| | C23H43BrNO11R<br>BrAcdPEG9CO | | |
| 75 | 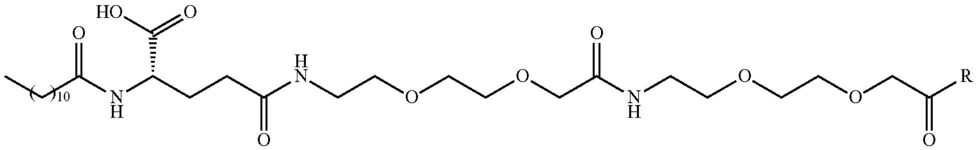 | | CCCCCCCCCCCC(N[C@@H](CCC<br>(NCCOCCOCC(NCCOCCOCC([R])=<br>O)=O)=O)C(O)=O)=O |
| | C29H52N3O10R<br>C12gEPEG2PEG2,<br>C12gEPEG2PEG2CO | | |
| 76 | 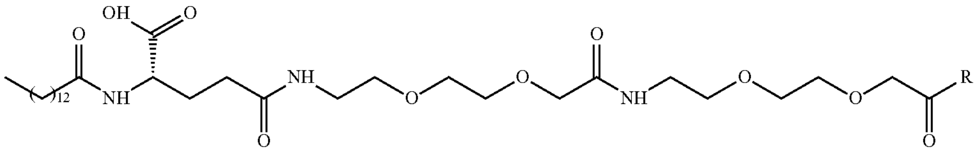 | | CCCCCCCCCCCCCC(N[C@@H]<br>(CCC(NCCOCCOCC(NCCOCCOCC<br>([R])=O)=O)=O)C(O)=O)=O |
| | C31H56N3O10R<br>C14gEPEG2PEG2,<br>C14gEPEG2PEG2CO | | |

TABLE 2D-continued

Peg Moeties and Peg Modified Monomers

| 1 | Structure | Names and Synonyms | Smiles Structure |
|---|---|---|---|
| 77 | 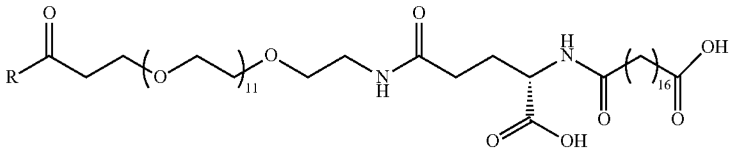<br>C50H93N2O19R<br>C18OHgEPEG12, HOC18gEPEG12 | | OC(CCCCCCCCCCCCCCCCC(N[C@@H](CCC(NCCOCCOCCOCCOCCOCCOCCOCCOCCOCCOCCOCCOCCOCCC([R])=O)=O)C(O)=O)=O)=O |
| 78 | 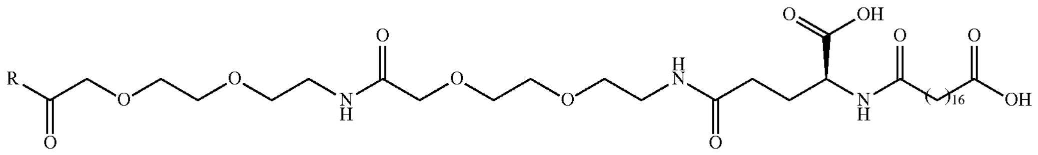<br>C35H62N3O12R<br>C18OHgEPEG2PEG2, HOC18gEPEG2PEG2<br>PEG2PEG2gEC18OH | | OC(CCCCCCCCCCCCCCCCC(N[C@@H](CCC(NCCOCCOCC(NCCOCCOCC([R])=O)=O)=O)C(O)=O)=O)=O<br>OC(CCCCCCCCCCCCCCCCC(N[C@@H](CCC(NCCOCCOCC(NCCOCCOCC([R])=O)=O)=O)C(O)=O)=O)=O<br>OC(CCCCCCCCCCCCCCCCC(N[C@@H](CCC(NCCOCCOCC(NCCOCCOCC=O)=O)=O)C(O)=O)=O)=O |
| 79 | 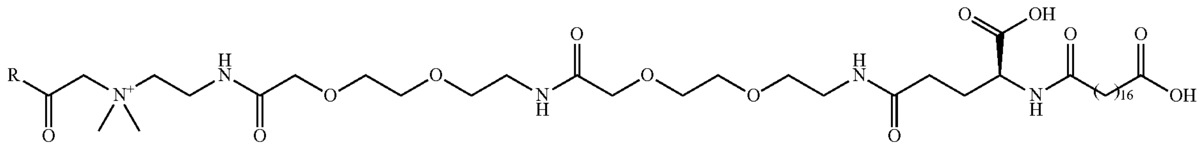<br>C41H75N5O13R+<br>C18OHgEPEG2PEG2SP6,<br>HOC18gEPEG2PEG2SP6 | | C[N+](C)(CCNC(COCCOCCNC(COCCOCCNC(CC[C@@H](C(O)=O)NC(CCCCCCCCCCCCCCCCC(O)=O)=O)=O)=O)=O)CC([R])=O |
| 80 | 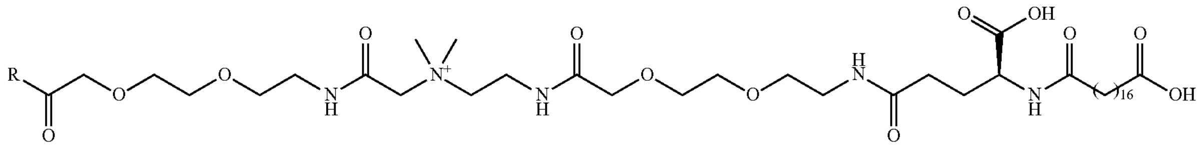<br>C41H75N5O13R+<br>C18OHgEPEG2SP6PEG2,<br>HOC18gEPEG2SP6PEG2 | | C[N+](C)(CCNC(COCCOCCNC(CC[C@@H](C(O)=O)NC(CCCCCCCCCCCCCCCCC(O)=O)=O)=O)=O)CC(NCCOCCOCC([R])=O)=O |

TABLE 2D-continued

| Peg Moeties and Peg Modified Monomers | | | |
|---|---|---|---|
| 1 | Structure | Names and Synonyms | Smiles Structure |
| 81 | 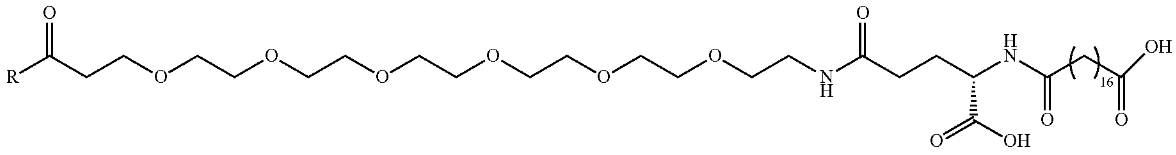 C38H69N2O13R C18OHgEPEG6, HOC18gEPEG6 | | OC(CCCCCCCCCCCCCCCCCC(N [C@@H](CCC(NCCOCCOCCO CCOCCOCCOCCC ([R])=O)=O)C(O)=O)=O)=O |
| 82 | 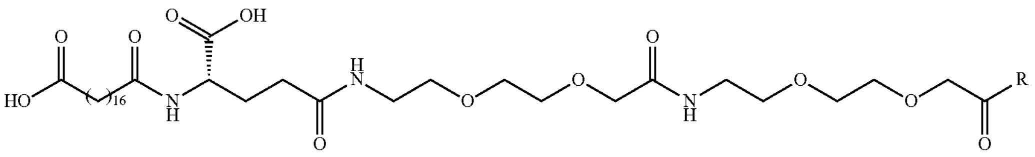 C37H66N3O12R C20OHgEPEG2PEG2, HOC20gEPEG2PEG2 | | OC(CCCCCCCCCCCCCCCCCCC(N [C@@H](CCC(NCCOCCOCC (NCCOCCOCC([R])=O)= O)=O)C(O)=O)=O)=O |
| 83 | 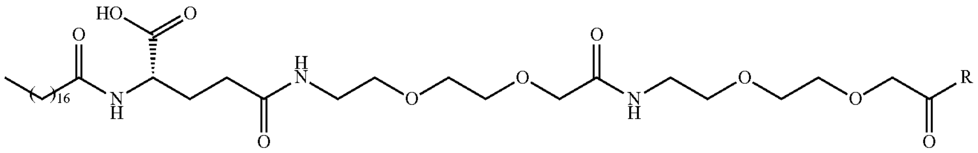 C37H68N3O10R C20gEPEG2PEG2 | | CCCCCCCCCCCCCCCCCCCC(N [C@@H](CCC(NCCOCCOCC (NCCOCCOCC([R])=O)=O)=O) C(O)=O)=O |
| 84 | 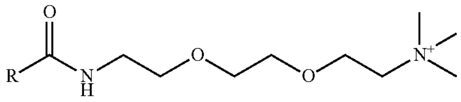 C10H22N2O3R+ CO(NHPEG3a) CON(PEG3a) CONHPEG3a | | C[N+](C)(C)CCOCCOCCNC([R])=O |

TABLE 2D-continued

| Peg Moeties and Peg Modified Monomers | | | |
|---|---|---|---|
| 1 | Structure | Names and Synonyms | Smiles Structure |
| 85 | 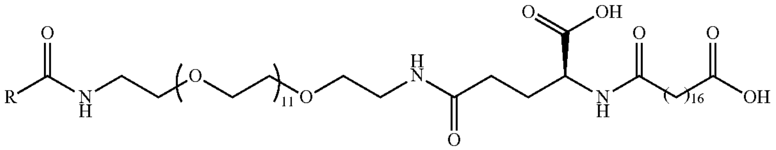<br>C50H94N3O19R<br>CO(PEG12gEC18OH) | | OC(CCCCCCCCCCCCCCCCC(N[C@@H](CCC(NCCOCCOCCOCCOCCOCCOCCOCCOCCOCCOCCOCCOCCOCCNC([R])=O)=O)C(O)=O)=O)=O |
| 86 | 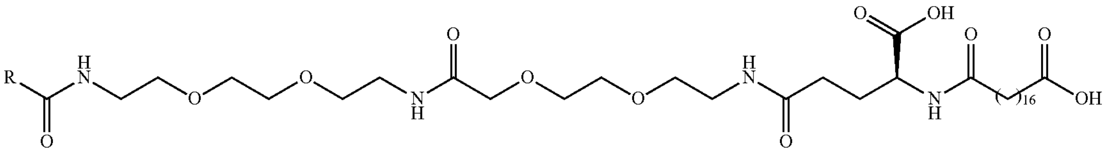<br>C36H65N4O12R<br>CO(PEG2PEG2gEC18OH) | | OC(CCCCCCCCCCCCCCCCC(N[C@@H](CCC(NCCOCCOCC(NCCOCCOCCNC([R])=O)=O)=O)C(O)=O)=O)=O |
| 87 | 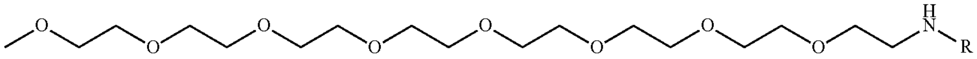<br>C17H36NO8R<br>CO(mPEG8) | | COCCOCCOCCOCCOCCOCCOCCOCCN[R] |
| 88 | 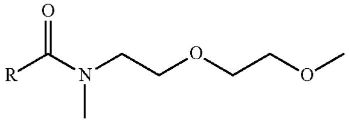<br>C7H14NO3R<br>CON(MePEG2) | | CN(CCOCCOC)C([R])=O |
| 89 | 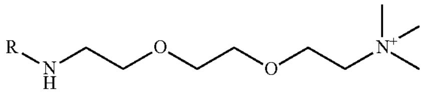<br>C9H22N2O2R+<br>CONH(PEG3a) | | C[N+](C)(C)CCOCCOCCN[R] |

TABLE 2D-continued

| Peg Moeties and Peg Modified Monomers | | | |
|---|---|---|---|
| 1 | Structure | Names and Synonyms | Smiles Structure |
| 90 | 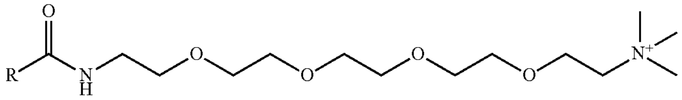<br>C14H30N2O5R+<br>CONH(PEG5a) | C[N+](C)(C)CCOCCOCCOCCOCCNC([R])=O | |
| 91 | 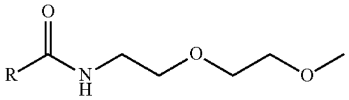<br>C6H12NO3R<br>CONH(mPEG2) | COCCOCCNC([R])=O | |
| 92 | 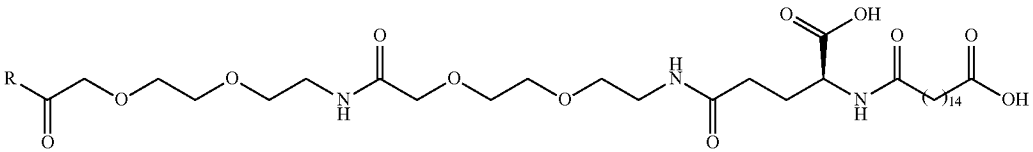<br>C33H58N3O12R<br>PEG2PEG2gEC16OH | OC(CCCCCCCCCCCCCCCC(N[C@@H](CCC(NCCOCCOCC(NCCOCCOCC([R])=O)=O)=O)C(O)=O)=O)=O<br>OC(CCCCCCCCCCCCCCCC(N[C@@H](CCC(NCCOCCOCC(NCCOCCOCC=O)=O)=O)C(O)=O)=O)=O | |
| 93 | 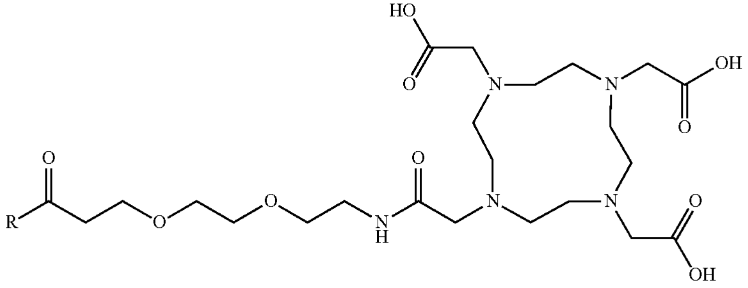<br>C23H40N5O10R<br>DOTA(dPEG2) | OC(CN1CCN(CC(O)=O)CCN(CC(O)=O)CCN(CC(NCCOCCOCCC([R])=O)=O)CC1)=O | |

TABLE 2D-continued

| Peg Moeties and Peg Modified Monomers | | | |
|---|---|---|---|
| 1 | Structure | Names and Synonyms | Smiles Structure |
| 94 | 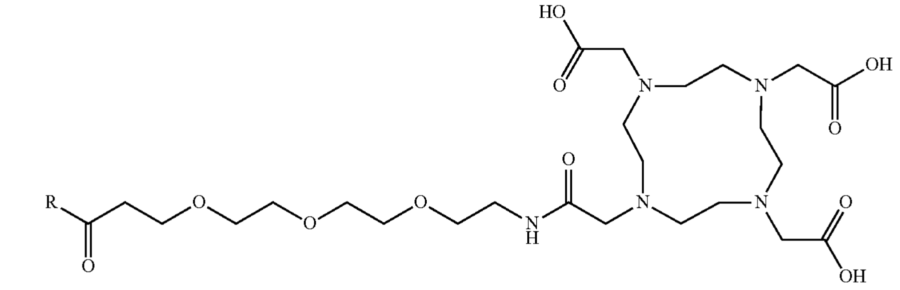 C25H44N5O11R DOTA(dPEG3) | OC(CN1CCN(CC(O)=O)CCN(CC(O)=O)CCN(CC(NCCOCCOCCOCCC([R])=O)=O)CC1)=O | |
| 95 | 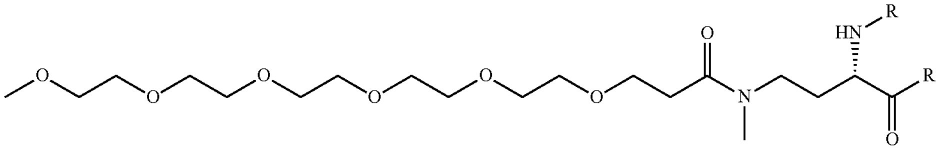 C19H36N2O8R2 Dab(NMeCOmPEG6) | CN(CC[C@@H](C([R])=O)N[R])C(CCOCCOCCOCCOCCOCCOC)=O | |
| 96 | 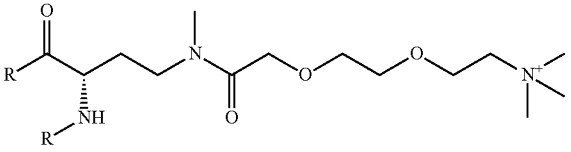 C14H28N3O4R2+ Dab(NMecPEG2aCO), Dab(NMecPEG2a) | CN(CC[C@@H](C([R])=O)N[R])C(COCCOCC[N+](C)(C)C)=O | |
| 97 | 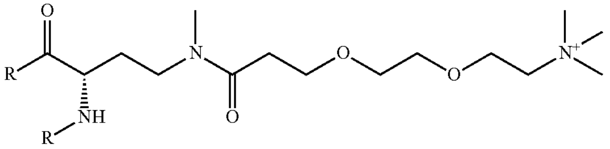 Dab(NMecPEG3aCO), Dab(NMecPEG3a) | CN(CC[C@@H](C([R])=O)N[R])C(CCOCCOCC[N+](C)(C)C)=O | |

TABLE 2D-continued
| Peg Moeties and Peg Modified Monomers | | | |
|---|---|---|---|
| 1 | Structure | Names and Synonyms | Smiles Structure |
| 98 | 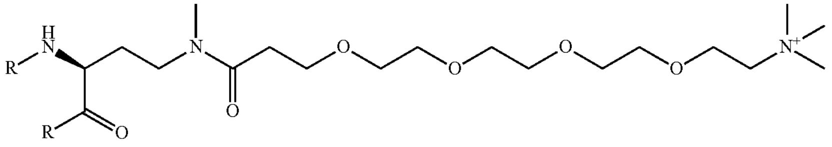<br>C19H38N3O6R2+<br>Dab(NMecPEG5aCO), Dab(NMecPEG5a) | | CN(CC[C@@H](C([R])=O)N[R])C(CCOCCOCCOCCOCC[N+](C)(C)C)=O |
| 99 | 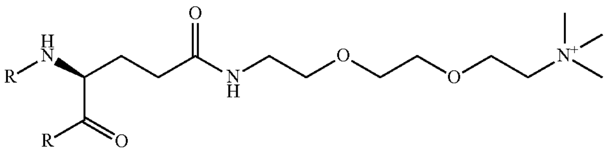<br>C14H28N3O4R2+<br>E(COcPEG3a)) | | C[N+](C)(C)CCOCCOCCNC(CC[C@@H](C([R1)=O)N[R])=O |
| 100 | 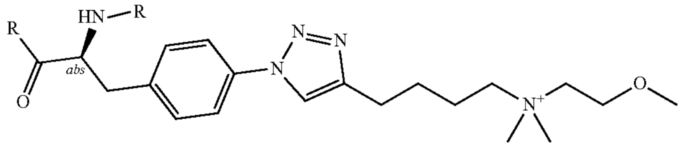<br>C20H30N5O2R2+<br>F(4TzlDMA4mPEG) | | C[N+](C)(CCCCc1cn(-c2ccc(C[C@@H](C([R])=O)N[R])cc2)nn1)CCOC |

TABLE 2D-continued
Peg Moeties and Peg Modified Monomers
| 1 | Structure | Names and Synonyms | Smiles Structure |
|---|---|---|---|
| 101 | 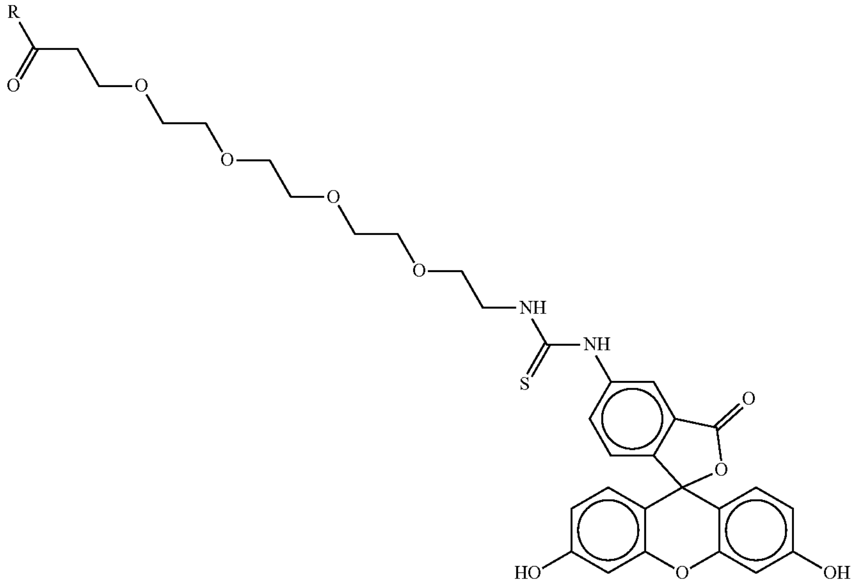<br>C32H33N2O10SR<br>FITCPEG4CO | | Oc1cc(Oc2c(C3(c(cc4)c5cc4NC(NCCOCCOCCOCCOCCC([R])=O)=S)OC5=O)ccc(O)c2)c3cc1 |
| 102 | 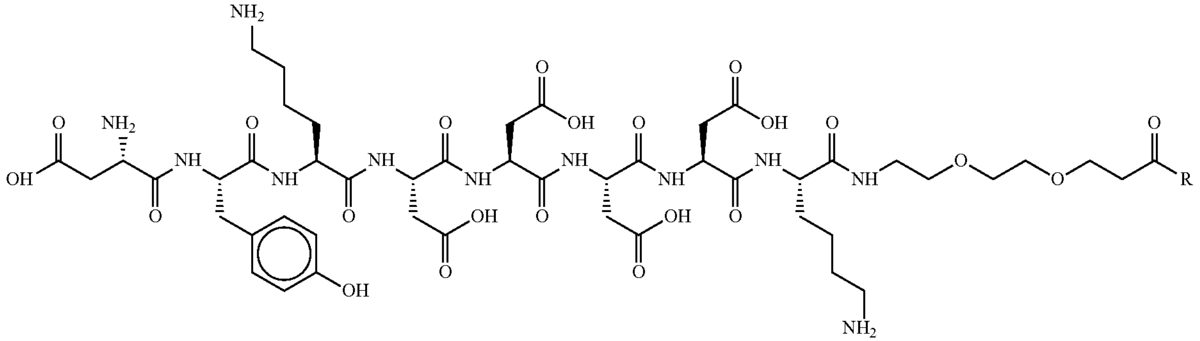 | | NCCCC[C@@H](C(NCCOCCOCCC([R])=O)=O)NC([C@H](CC(O)=O)NC([C@H](CC(O)=O)NC([C@H](CC(O)=O)NC([C@H](CC(O)=O)NC([C@H](CCCCN)NC([C@H](Cc(cc1)ccc1O)NC([C@H](CC(O)=O)N)=O)=O)=O)=O)=O)=O)=O |

TABLE 2D-continued

| Peg Moeties and Peg Modified Monomers | | | |
|---|---|---|---|
| 1 | Structure | Names and Synonyms | Smiles Structure |
| 103 | C48H72N11O22R<br>FlagTag(dPEG2)<br>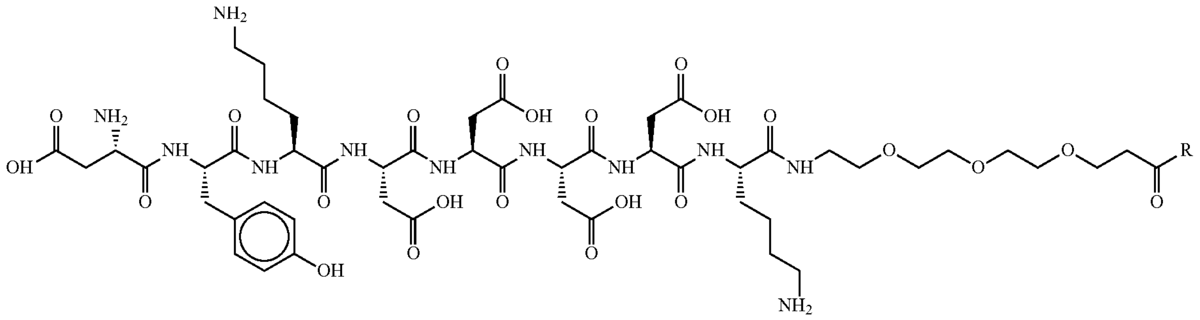 | | NCCCC[C@@H](C(NCCOCCOCCOCCC([R])=O)=O)NC([C@H](CC(O)=O)NC([C@H](CC(O)=O)NC([C@H](CC(O)=O)NC([C@H](CC(O)=O)NC([C@H](CCCCN)NC([C@H](Cc(cc1)ccc1O)NC([C@H](CC(O)=O)N)=O)=O)=O)=O)=O)=O)=O |
| 104 | FlagTag(dPEG3)<br>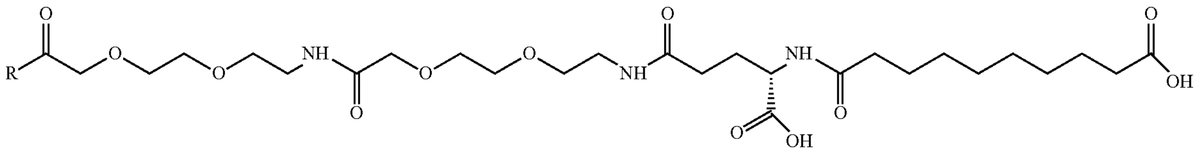<br>C27H46N3O12R<br>HOC10gEPEG2PEG2,<br>HOC10gEPEG2PEG2CO | | OC(CCCCCCCCC(N[C@@H](CCC(NCCOCCOCC(NCCOCCOCC([R])=O)=O)=O)C(O)=O)=O)=OOC(CCCCCCCCC(N[C@@H](CCC(NCCOCCOCC(NCCOCCOCC=O)=O)=O)C(O)=O)=O)=O |
| 105 | 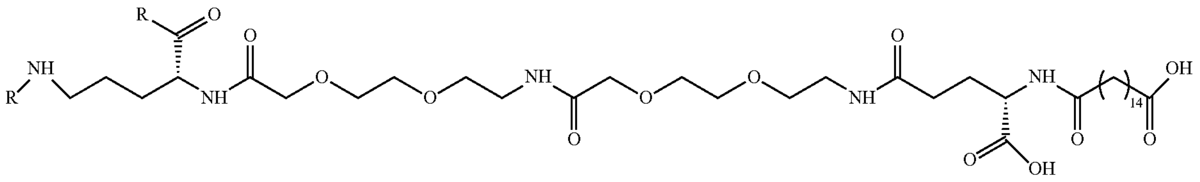<br>C38H67N5O13R2<br>HOC16gEPEG2PEG2orn,<br>HOC16OHgEPEG2PEG2orn(2) | | OC(CCCCCCCCCCCCCCC(N[C@@H](CCC(NCCOCCOCC(NCCOCCOCC(N[C@H](CCCN[R])C([R])=O)=O)=O)=O)C(O)=O)=O)=ONCCC[C@H](C=O)NC(COCCOCCNC(COCCOCCNC(CC[C@@H](C(O)=O)NC(CCCCCCCCCCCCCCC(O)=O)=O)=O)=O)=O |

TABLE 2D-continued

| Peg Moeties and Peg Modified Monomers | | | |
|---|---|---|---|
| 1 | Structure | Names and Synonyms | Smiles Structure |
| 106 | 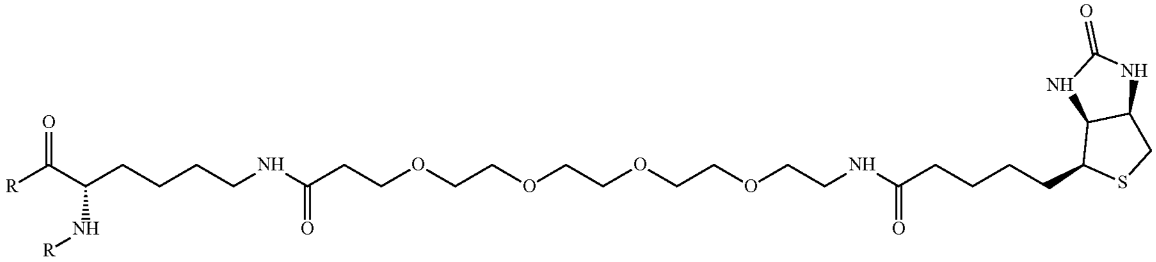<br>C27H47N5O8SR2<br>K(BiotinPEG4) | | O=C(CCCC[C@@H]([C@H]1N2)SC[C@@H]1NC2=O)NCCOCCOCCOCCOCCC(NCCCC[C@@H](C([R])=O)N[R])=O |
| 107 | 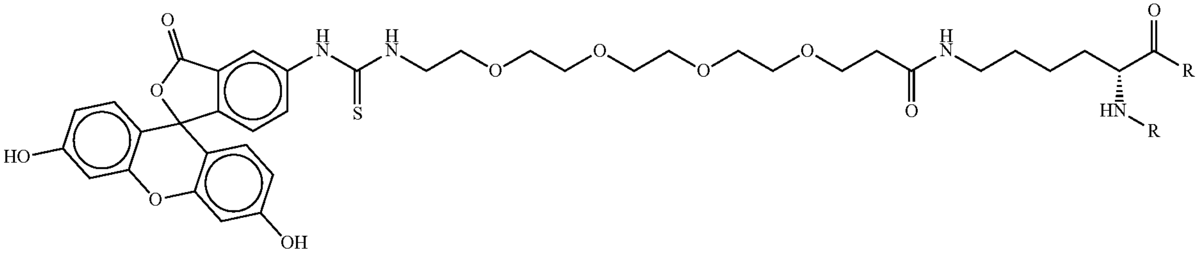<br>C38H44N4O11SR2<br>K(FITCPEG4) | | Oc1cc(Oc2c(C3(c(cc4)c5cc4NC(NCCOCCOCCOCCOCCC(NCCCC[C@@H](C([R])=O)N[R])=O)=S)OC5=O)ccc(O)c2)c3cc1 |
| 108 | 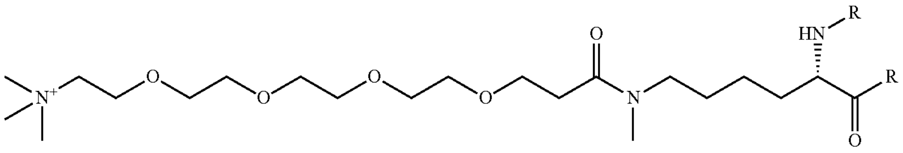<br>C21H42N3O6R2+<br>K(NMeCOPEG4N + Me3) | | CN(CCCC[C@@H](C([R])=O)N[R])C(CCOCCOCCOCCOCC[N+](C)(C)C)=O |

TABLE 2D-continued

Peg Moeties and Peg Modified Monomers

| 1 | Structure | Names and Synonyms | Smiles Structure |
|---|---|---|---|
| 109 | 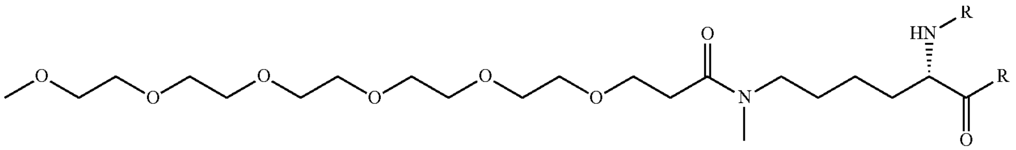 | C21H40N2O8R2<br>K(NMeCOmPEG6) | CN(CCCC[C@@H](C([R])=O)N[R])C(CCOCCOCCOCCOCCOCCOC)=O |
| 110 | 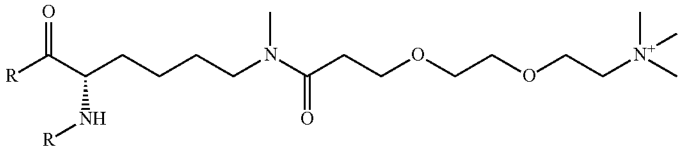 | C17H34N3O4R2+<br>K(NMePEG3a), K(NMecPEG3a),<br>K(NMecPEG3aCO) | CN(CCCC[C@@H](C([R])=O)N[R])C(CCOCCOCC[N+](C)(C)C)=O |
| 111 | 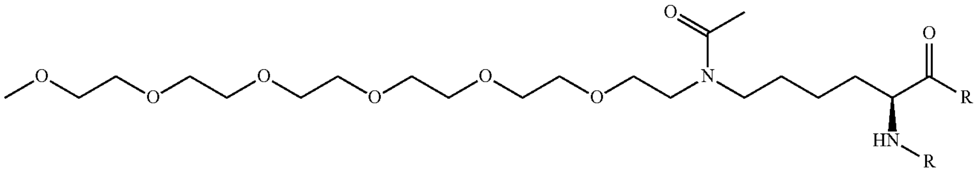 | C21H40N2O8R2<br>K(NmPEG6Ac) | CC(N(CCCC[C@@H](C([R])=O)N[R])CCOCCOCCOCCOCCOCCOC)=O |
| 112 | 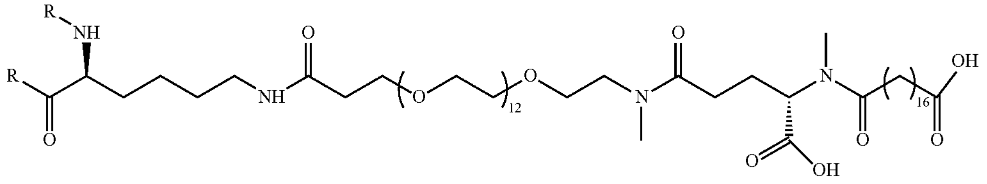 | C58H108N4O20R2<br>K(PEG12NMegENMeC18OH) | CN(CCOCCOCCOCCOCCOCCOCCOCCOCCOCCOCCOCCC(NCCCC[C@@H](C([R])=O)N[R])=O)C(CC[C@@H](C(O)=O)N(C)C(CCCCCCCCCCCCCCCCCC(O)=O)=O)=O |

TABLE 2D-continued

| Peg Moeties and Peg Modified Monomers | | | |
|---|---|---|---|
| 1 | Structure | Names and Synonyms | Smiles Structure |
| 113 | 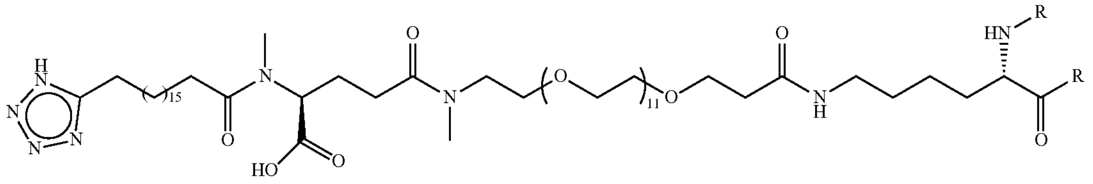<br>C59H110N8O18R2<br>K(PEG12NMegENMeC18Tetrazole) | | CN(CCOCCOCCOCCOCCOCCOCCO<br>CCOCCOCCOCCOCCOCCOCCC(NCCCC<br>[C@@H](C([R])=O)N[R])=O)C(CC<br>[C@@H](C(O)=O)N(C)C<br>(CCCCCCCCCCCCCCCCC<br>c1nnn[nH]1)=O)=O |
| 114 | 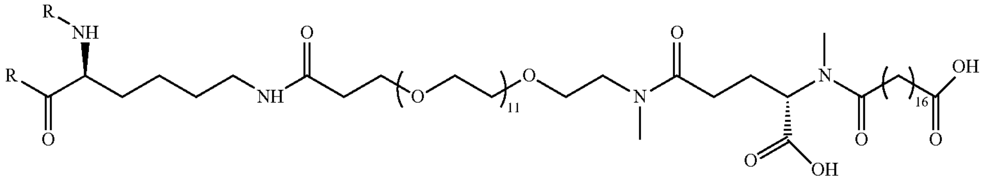<br>C56H104N4O20R2<br>K(PEG12gEC18OH) | | OC(CCCCCCCCCCCCCCCCC(N<br>[C@@H](CCC(NCCOCCOCCOCCO<br>CCOCCOCCOCCOCCOCCOCCO<br>CCOCCC(NCCCC<br>[C@@H](C([R])=O)N[R])=O)=<br>O)C(O)=O)=O)=O |
| 115 | 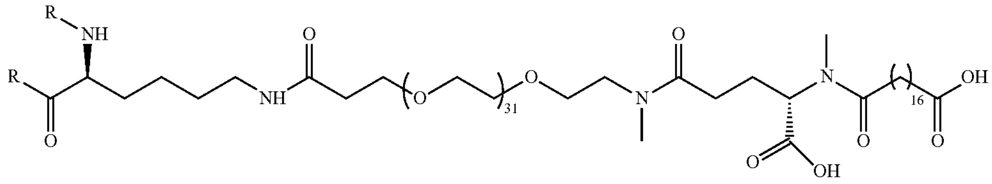<br>C58H108N4O20R2<br>K(PEG12gEC20OH) | | OC(CCCCCCCCCCCCCCCCCCC(N<br>[C@@H](CCC(NCCOCCOCCOCCO<br>CCOCCOCCOCCOCCOCCOCCO<br>CCOCCC(NCCCC[C@@H](C([R])=O)<br>N[R])=O)=O)C(O)=O)=O)=O |
| 116 | 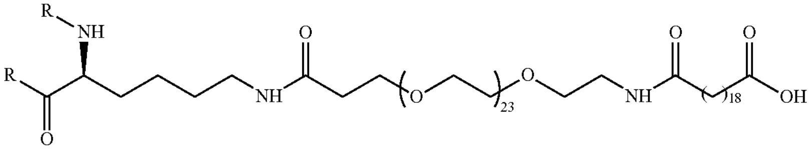<br>C75H145N3O29R2<br>K(PEG24C18OH) | | OC(CCCCCCCCCCCCCCCCC<br>(NCCOCCOCCOCCOCCOCCOCCO<br>CCOCCOCCOCCOCCOCCOCCO<br>CCOCCOCCOCCOCCOCCOCCOCC<br>OCCOCCOCCC(NCCCC[C@@H]<br>(C([R])=O)N[R])=O)=O)=O |

TABLE 2D-continued

| Peg Moeties and Peg Modified Monomers | | | |
|---|---|---|---|
| 1 | Structure | Names and Synonyms | Smiles Structure |
| 117 | 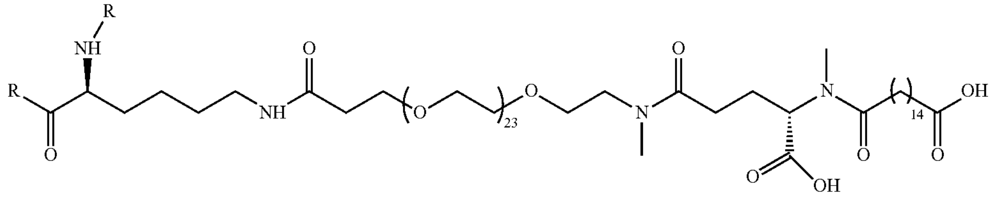<br>C78H148N4O32R2<br>K(PEG24gEC16OH) | | OC(CCCCCCCCCCCCCCCC(N[C@@H](CCC(NCCOCCOCCOCCOCCOCCOCCOCCOCCOCCOCCOCCOCCOCCOCCOCCOCCOCCOCCOCCOCCOCCOCCOCCC(NCCCC[C@@H](C([R])=O)N[R])=O)=O)C(O)=O)=O)=O |
| 118 | 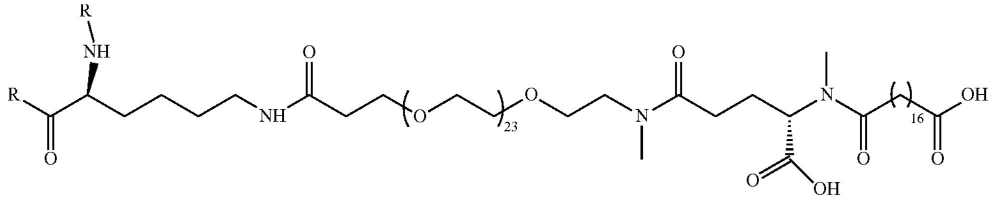<br>C81H154N4O32R2<br>K(PEG24gEC18OH) | | C[C@](CCCCNC(CCOCCOCCOCCOCCOCCOCCOCCOCCOCCOCCOCCOCCOCCOCCOCCOCCOCCOCCOCCOCCOCCOCCOCCNC(CC[C@@H](C(O)=O)NC(CCCCCCCCCCCCCCCCC(O)=O)=O)=O)=O)(C([R])=O)N[R] |
| 119 | 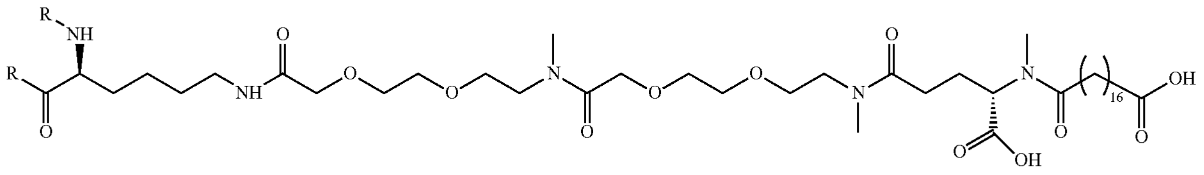<br>C44H79N5O13R2<br>K(PEG2NMePEG2NMegENMeC18OH) | | CN(CCOCCOCC(N(C)CCOCCOCC(NCCCC[C@@H](C([R])=O)N[R])=O)=O)C(CC[C@@H](C(O)=O)N(C)C(CCCCCCCCCCCCCCCCC(O)=O)=O)=O |

TABLE 2D-continued

| Peg Moeties and Peg Modified Monomers | | | |
|---|---|---|---|
| 1 | Structure | Names and Synonyms | Smiles Structure |
| 120 | 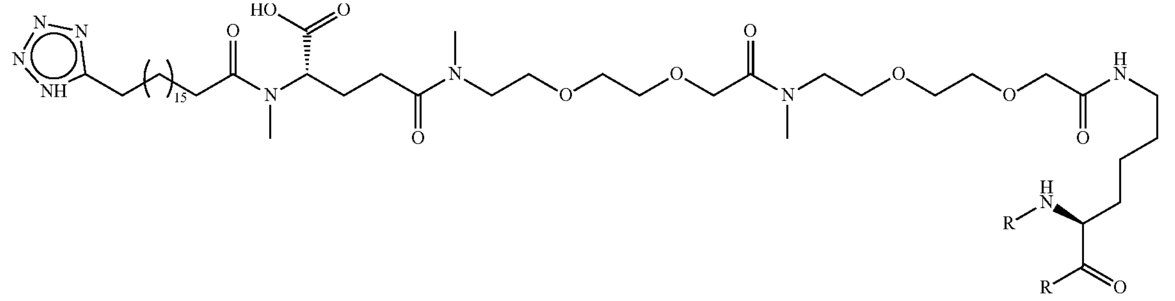 C45H81N9O11R2 K(PEG2NMePEG2NMegENMeC18Tetrazole | | CN(CCOCCOCC(N(C)CCOCCOCC (NCCCC[CC(O)=O)N(C)C (CCCCCCCCCCCCCCCCCc1nnn [nH]1)=O)=O |
| 121 | 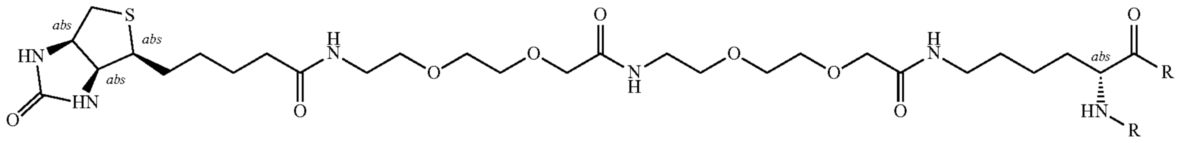 C28H48N6O9SR2 K(PEG2PEG2Biotin) | | O=C(CCCC[C@@H]([C@H]1N2)SC [C@@H]1NC2=O)NCCOCCOCC (NCCOCCOCC(NCCCC [C@@H](C([R])=O)N[R])=O)=O |
| 122 | 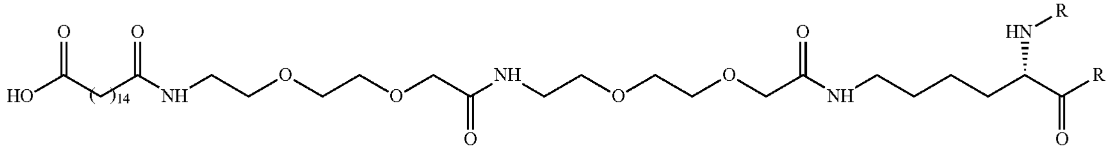 C34H62N4O10R2 K(PEG2PEG2C16OH) | | OC(CCCCCCCCCCCCCCC (NCCOCCOCC (NCCOCCOCC(NCCCC[C@@H] (C([R])=O)N[R])=O)=O)=O)=O |

TABLE 2D-continued

Peg Moeties and Peg Modified Monomers

| 1 | Structure | Names and Synonyms | Smiles Structure |
|---|---|---|---|
| 123 | 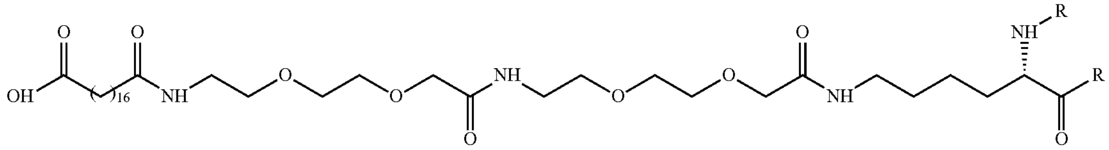<br>C36H66N4O10R2<br>K(PEG2PEG2C18OH) | | OC(CCCCCCCCCCCCCCCCC(NCCOCCOCC(NCCOCCOCC(NCCCC[C@@H](C([R])=O)N[R])=O)=O)=O)=O |
| 124 | 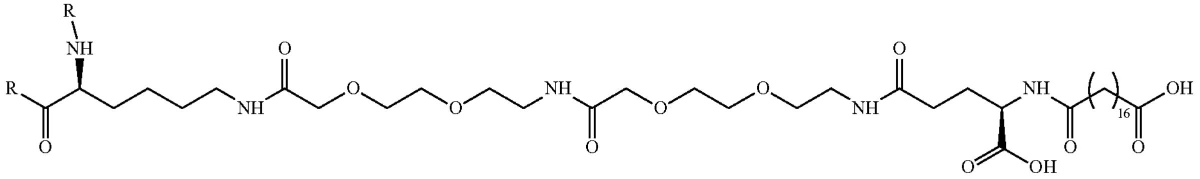<br>C41H73N5O13R2<br>K(PEG2PEG2DgEC18OH) | | OC(CCCCCCCCCCCCCCCCC(N[C@H](CCC(NCCOCCOCC(NCCOCCOCC(NCCCC[C@@H](C([R])=O)N[R])=O)=O)=O)C(O)=O)=O)=O |
| 125 | 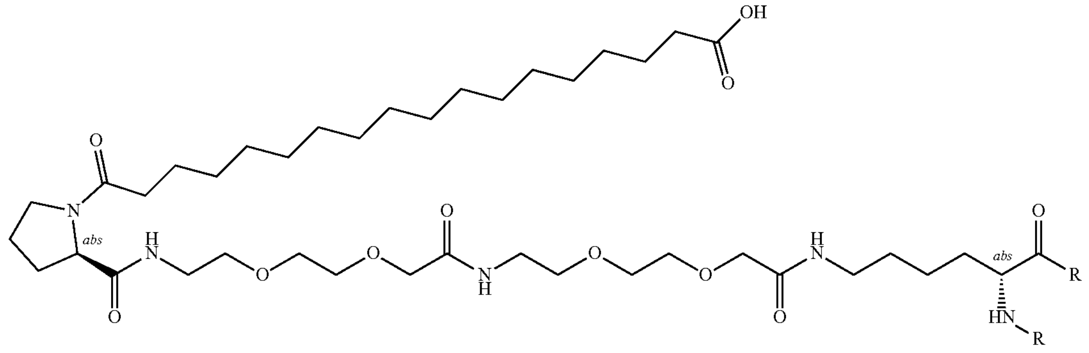<br>C41H73N5O11R2<br>K(PEG2PEG2PC18OH) | | OC(CCCCCCCCCCCCCCCCC(N(CCC1)[C@@H]1C(NCCOCCOCC(NCCOCCOCC(NCCCC[C@@H](C[R])=O)N[R])=O)=O)=O)=O)=O |

TABLE 2D-continued

| Peg Moeties and Peg Modified Monomers | | | |
|---|---|---|---|
| 1 | Structure | Names and Synonyms | Smiles Structure |
| 126 | 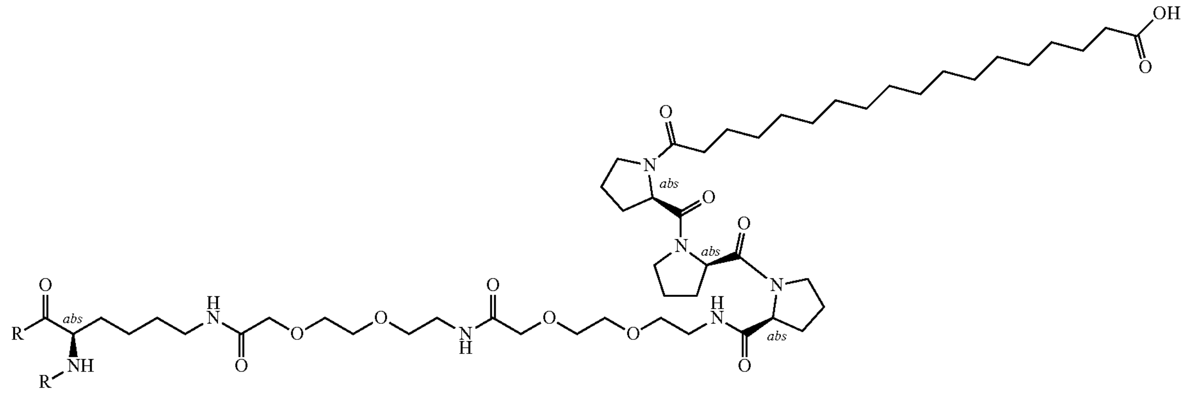<br>C51H87N7O13R2<br>K(PEG2PEG2PPPC18OH) | OC(CCCCCCCCCCCCCCCCC(N(CCC1)[C@@H]1C(N(CCC1)[C@@H]1C(N(CCC1)[C@@H]1C(NCCOCCOCC(NCCOCCOCC(NCCCC[C@@H](C([R])=O)N[R])=O)=O)=O)=O)=O)=O)=O | |
| 127 | 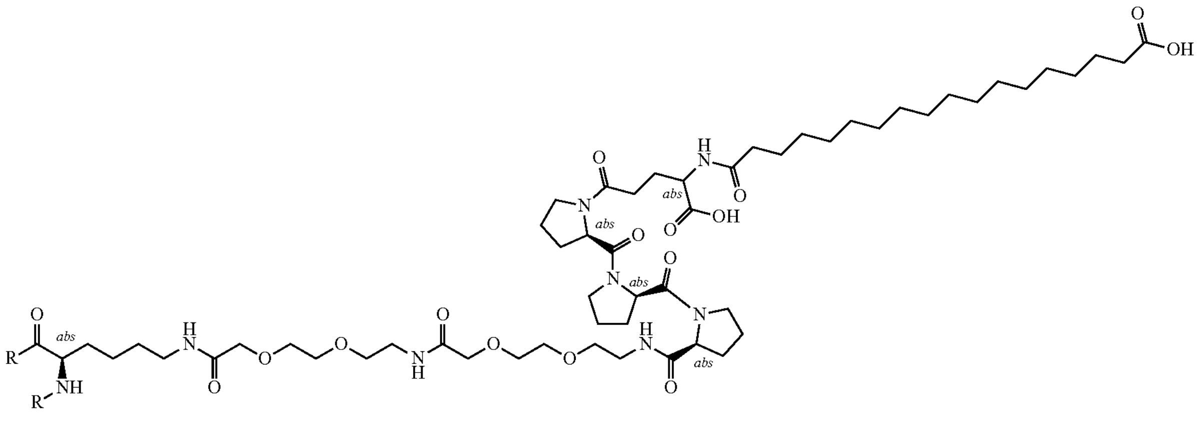<br>C56H94N8O16R2<br>K(PEG2PEG2PPPgEC18OH) | OC(CCCCCCCCCCCCCCCCC(N[C@@H](CCC(N(CCC1)[C@@H]1C(N(CCC1)[C@@H]1C(N(CCC1)[C@@H]1C(NCCOCCOCC(NCCOCCOCC(NCCCC[C@@H](C([R])=O)N[R])=O)=O)=O)=O)=O)=O)C(O)=O)=O)=O | |

TABLE 2D-continued

| Peg Moeties and Peg Modified Monomers | | | |
|---|---|---|---|
| 1 | Structure | Names and Synonyms | Smiles Structure |
| 128 | 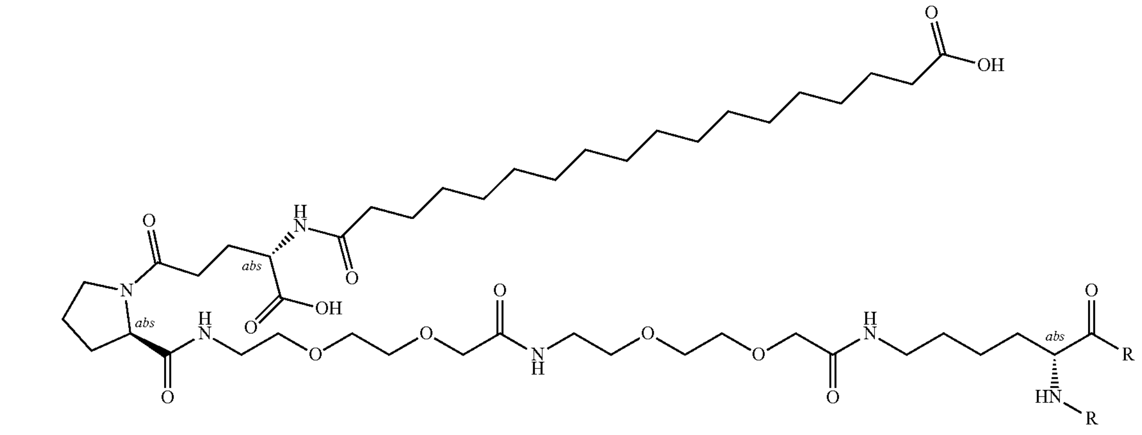<br>C46H80N6O14R2<br>K(PEG2PEG2PgEC18OH) | | OC(CCCCCCCCCCCCCCCCC(N[C@@H](CCC(N(CCC1)[C@@H]1C(NCCOCCOCC(NCCOCCOCC(NCCCC[C@@H](C([R])=O)N[R])=O)=O)=O)=O)C(O)=O)=O)=O |
| 129 | 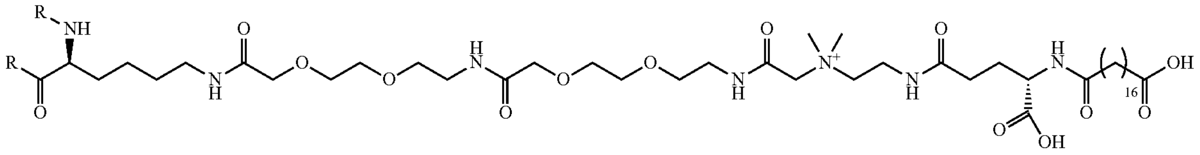<br>C47H86N7O14R2+<br>K(PEG2PEG2Sp6gEC18OH) | | C[N+](C)(CCNC(CC[C@@H](C(O)=O)NC(CCCCCCCCCCCCCCCCC(O)=O)=O)=O)CC(NCCOCCOCC(NCCOCCOCC(NCCCC[C@@H](C([R])=O)N[R])=O)=O)=O |
| 130 | 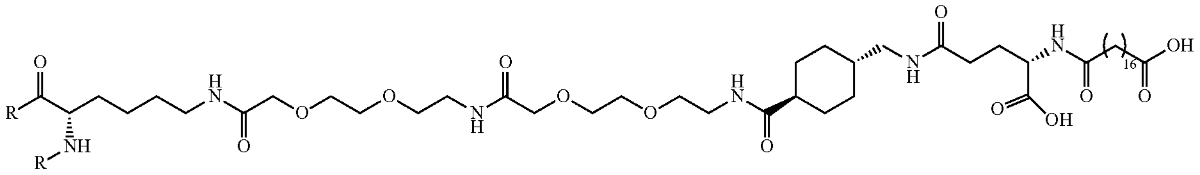<br>C49H86N6O14R2<br>K(PEG2PEG2TrxgEC18OH) | | OC(CCCCCCCCCCCCCCCCC(N[C@@H](CCC(NC[C@H](CC1)CC[C@@H]1C(NCCOCCOCC(NCCOCCOCC(NCCCC[C@@H](C([R])=O)N[R])=O)=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 131 | 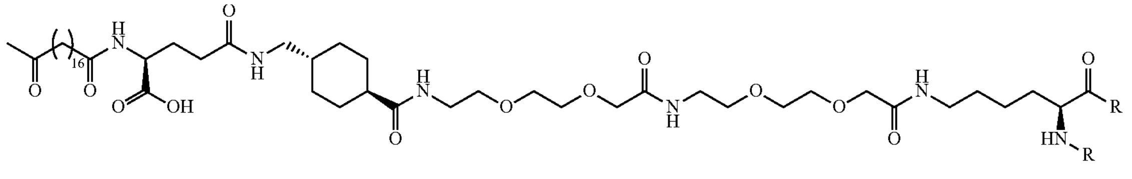<br>C51H90N6I14R2<br>K(PEG2PEG2TrxgEC20OH) | | OC(CCCCCCCCCCCCCCCCCCC(N[C@@H](CCC(NC[C@H](CC1)CC[C@@H]1C(NCCOCCOCC(NCCOCCOCC(NCCCC[C@@H](C([R])=O)N[R])=O)=O)=O)=O)C(O)=O)=O)=O |
| 132 | 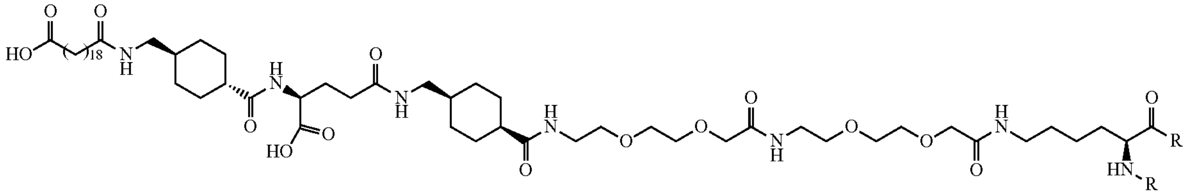<br>C59H103N7O15R2<br>K(PEG2PEG2TrxgETrxC20OH) | | |
| 133 | 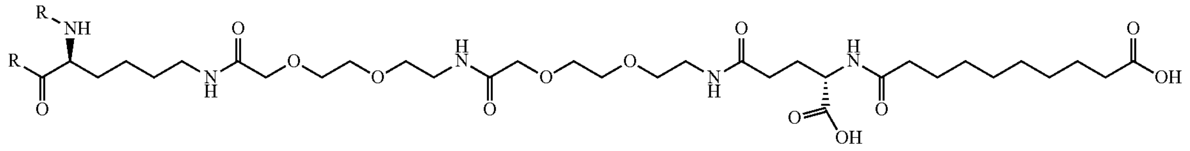<br>C33H57N5O13R2<br>K(PEG2PEG2gEC10OH) | | OC(CCCCCCCCC(N[C@@H](CCC(NCCOCCOCC(NCCOCCOCC(NCCCC[C@@H](C([R])=O)N[R])=O)=O)=O)C(O)=O)=O)=O |
| 134 | 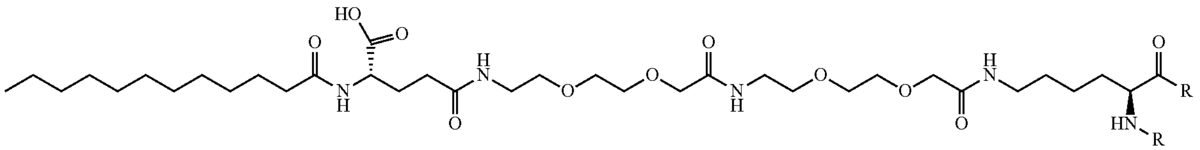<br>C35H63N5O11R2<br>K(PEG2PEG2gEC12) | | CCCCCCCCCCCC(N[C@@H](CCC(NCCOCCOCC(NCCOCCOCC(NCCCC[C@@H](C([R])=O)N[R])=O)=O)=O)C(O)=O)=O |

TABLE 2D-continued

Peg Moeties and Peg Modified Monomers

| 1 | Structure | Names and Synonyms | Smiles Structure |
|---|---|---|---|
| 135 | 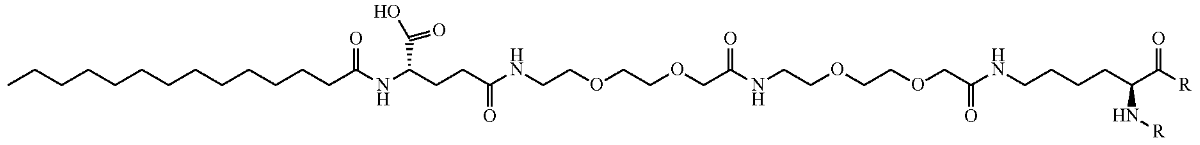 | C37H67N5O11R2<br>K(PEG2PEG2gEC14)<br>NMeK(PEG2PEG2gEC14) | CCCCCCCCCCCCCC(N[C@@H]<br>(CCC(NCCOCCOCC(NCCOCCOCC<br>(NCCCC[C@@H](C([R])=O)N[R])=<br>O)=O)=O)C(O)=O)=O |
| 136 | 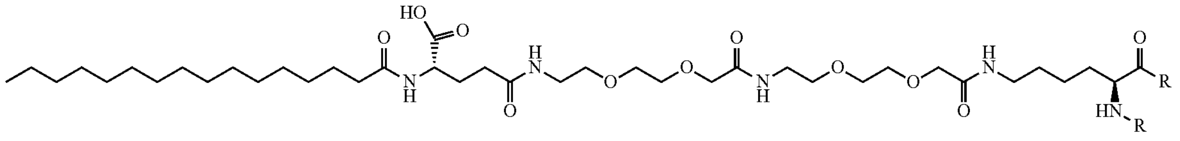 | C39H71N5O11R2<br>K(PEG2PEG2gEC16) | CCCCCCCCCCCCCCCC(N[C@@H]<br>(CCC(NCCOCCOCC(NCCOCCOCC<br>(NCCCC[C@@H](C([R])=O)<br>N[R])=O)=O)=O)C(O)=O)=O |
| 137 | 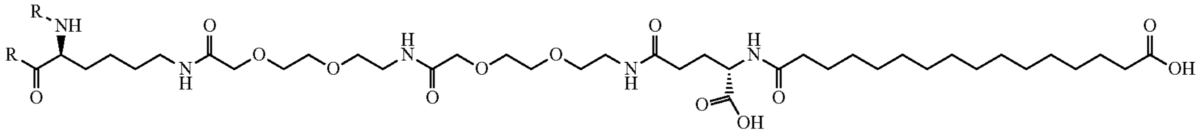 | C39H69N5O13R2<br>K(PEG2PEG2gEC16OH) | OC(CCCCCCCCCCCCCCC(N<br>[C@@H](CCC(NCCOCCOCC<br>(NCCOCCOCC(NCCCC[C@@H]<br>(C([R])=O)N[R])=O)=O)=O)C<br>(O)=O)=O)=O |
| 138 | 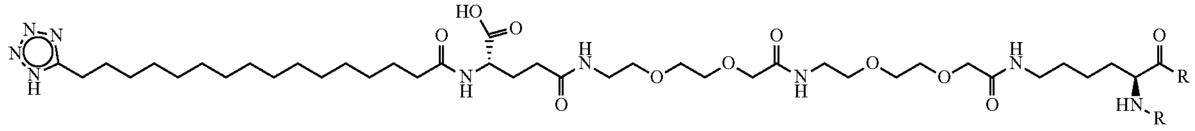 | C40H71N9O11R2<br>K(PEG2PEG2gEC16tetrazole) | OC([C@H](CCC(NCCOCCOCC<br>(NCCOCCOCC(NCCCC[C@@H](C<br>([R])=O)N[R])=O)=O)=O)NC<br>(CCCCCCCCCCCCCCCc1nnn<br>[nH]1)=O)=O |
| 139 | 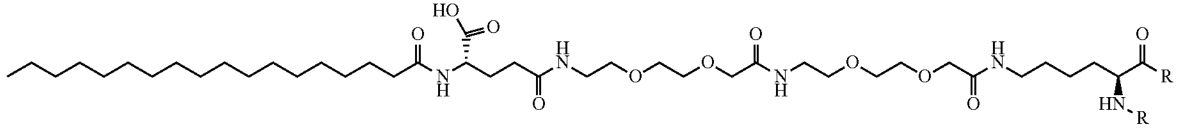 | | CCCCCCCCCCCCCCCCCC(N<br>[C@@H](CCC(NCCOCCOCC<br>(NCCOCCOCC(NCCCC[C@@H]<br>(C([R])=O)N[R])=O)=O)=O)<br>C(O)=O)=O |

TABLE 2D-continued

| Peg Moeties and Peg Modified Monomers | | | |
|---|---|---|---|
| 1 | Structure | Names and Synonyms | Smiles Structure |
| | C41H75N5O11R2<br>K(PEG2PEG2gEC18) | | |
| 140 | 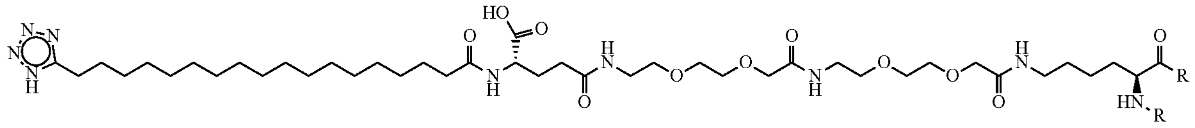 | | OC([C@H](CCC(NCCOCCOCC(NCCOCCOCC(NCCCC[C@@H](C([R])=O)N[R])=O)=O)=O)NC(CCCCCCCCCCCCCCCCCc1nnn[nH]1)=O)=O |
| | C42H75N9O11R2<br>K(PEG2PEG2gEC18tetrazole) | | |
| 141 | 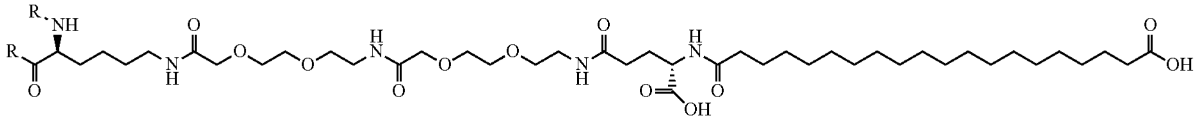 | | OC(CCCCCCCCCCCCCCCCCCC(N[C@@H](CCC(NCCOCCOCC(NCCOCCOCC(NCCCC[C@@H](C([R])=O)N[R])=O)=O)=O)C(O)=O)=O)=O |
| | C43H77N5O13R2<br>K(PEG2PEG2gEC20OH) | | |
| 142 | 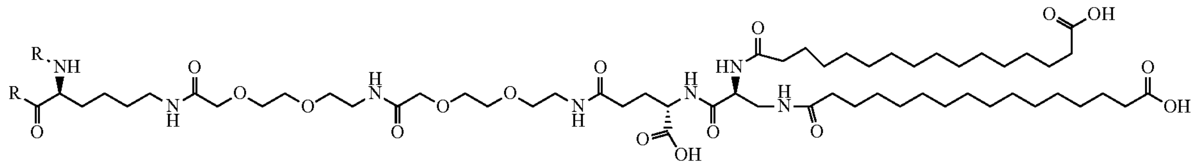 | | OC(CCCCCCCCCCCCCCC(NC[C@@H](C(N[C@@H](CCC(NCCOCCOCC(NCCOCCOCC(NCCCC[C@@H](C([R])=O)N[R])=O)=O)=O)C(O)=O)=O)NC(CCCCCCCCCCCCCCC(O)=O)=O)=O)=O |
| | C58H103N7O17R2<br>KPEG2PEG2gEDap(C16OH)2,<br>K(PEG2PEG2gEDAP(C16OH)2) | | |

TABLE 2D-continued
| Peg Moeties and Peg Modified Monomers | | | |
|---|---|---|---|
| 1 | Structure | Names and Synonyms | Smiles Structure |
| 143 | 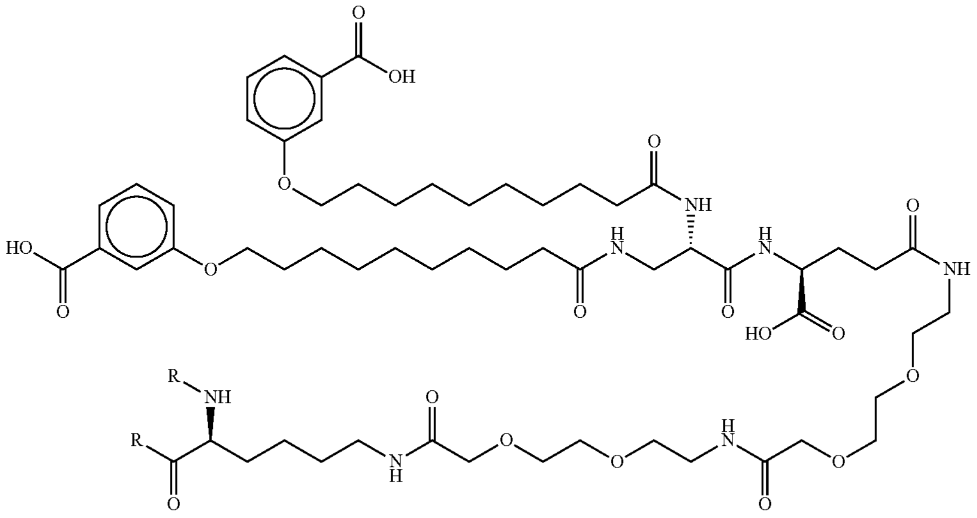<br>C60H91N7O19R2<br>K(PEG2PEG2gEDAP(mXOH)2)<br>KPEG2PEG2gEDAP(mXOH)2 | | OC([(CCC(NCCOCCOCC(NCCOCC OCC(NCCCC[C@@H](C([R])=O) N[R])=O)=O)=O)NC([C@H](CNC (CCCCCCCCCOc1cc(C(O)=O) ccc1)=O)NC(CCCCCCCCCOc1cc (C(O)=O)ccc1)=O)=O)=O |

TABLE 2D-continued

| Peg Moeties and Peg Modified Monomers | | | |
|---|---|---|---|
| 1 | Structure | Names and Synonyms | Smiles Structure |
| 144 | 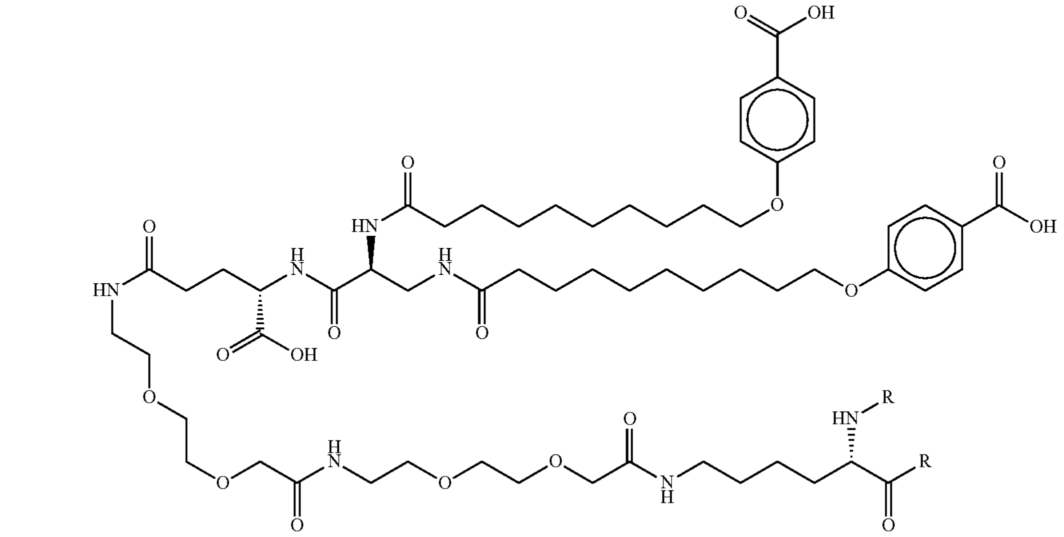<br>C60H91N7O19R2<br>K(PEG2PEG2gEDAP(pXOH)2)<br>KPEG2PEG2gEDAP(pXOH)2 | OC([C@H](CCC(NCCOCCOCC<br>(NCCOCCOCC(NCCCC[C@@H]<br>(C([R])=O)N[R])=O)=O)=O)NC<br>([C@H](CNC(CCCCCCCCCCOc<br>(cc1)ccc1C(O)=O)=O)NC<br>(CCCCCCCCCCOc(cc1)ccc1C<br>(O)=O)=O)=O)=O | |
| 145 | 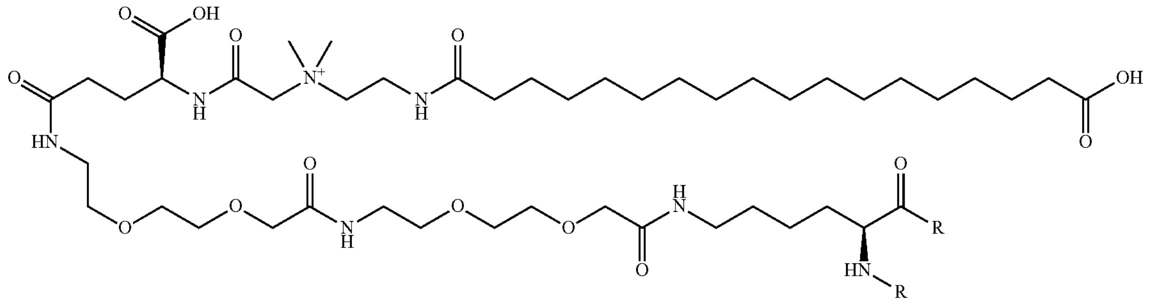<br>C47H86N7O14R2+<br>K(PEG2PEG2gESp6C18OH) | C[N+](C)(CCNC(CCCCCCCCCCCC<br>CCCCC(O)=O)=O)CC(N[C@@H]<br>(CCC(NCCOCCOCC(NCCOCCOCC<br>(NCCCC[C@@H](C([R])=O)N[R])=<br>O)=O)=O)C(O)=O)=O | |

TABLE 2D-continued

Peg Moeties and Peg Modified Monomers

| 1 | Structure | Names and Synonyms | Smiles Structure |
| --- | --- | --- | --- |
| 146 | 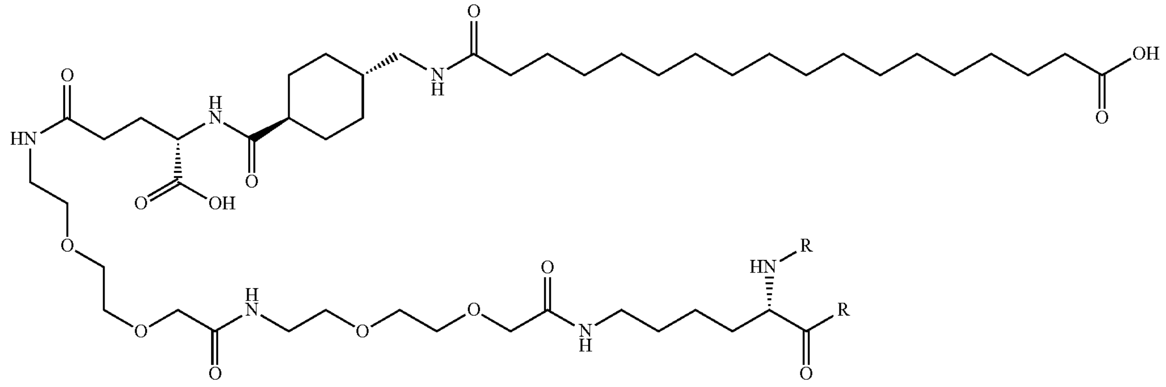<br>C49H86N6O14R2<br>K(PEG2PEG2gETrxC18OH) | | OC(CCCCCCCCCCCCCCCCC(NC[C@H](CC1)CC[C@@H]1C(N[C@@H](CCC(NCCOCCOCC(NCCOCCOCC(NCCCC[C@@H](C([R])=O)N[R])=O)=O)=O)C(O)=O)=O)=O)=O |
| 147 | 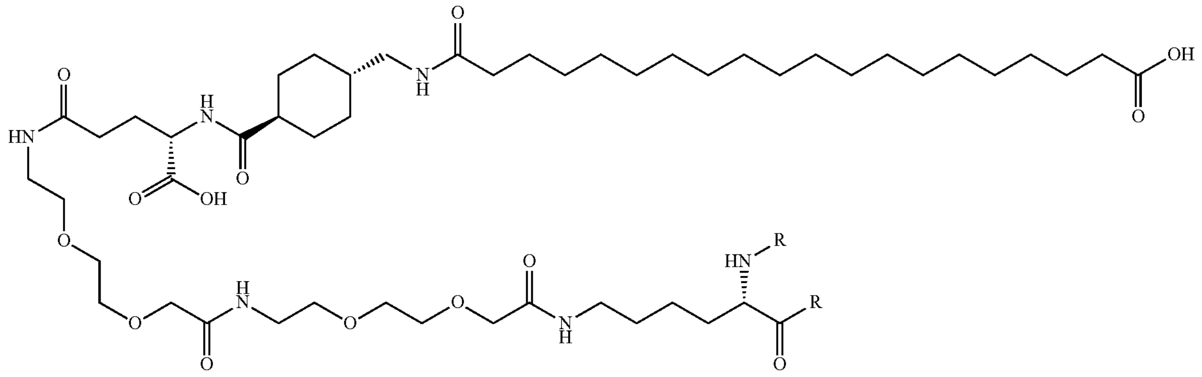<br>C51H90N6O14R2<br>K(PEG2PEG2gETrxC20OH) | | OC(CCCCCCCCCCCCCCCCCCC(NC[C@H](CC1)CC[C@@H]1C(N[C@@H](CCC(NCCOCCOCC(NCCOCCOCC(NCCCC[C@@H](C([R])=O)N[R])=O)=O)=O)C(O)=O)=O)=O)=O |

TABLE 2D-continued
| Peg Moeties and Peg Modified Monomers | | | |
|---|---|---|---|
| 1 | Structure | Names and Synonyms | Smiles Structure |
| 148 | 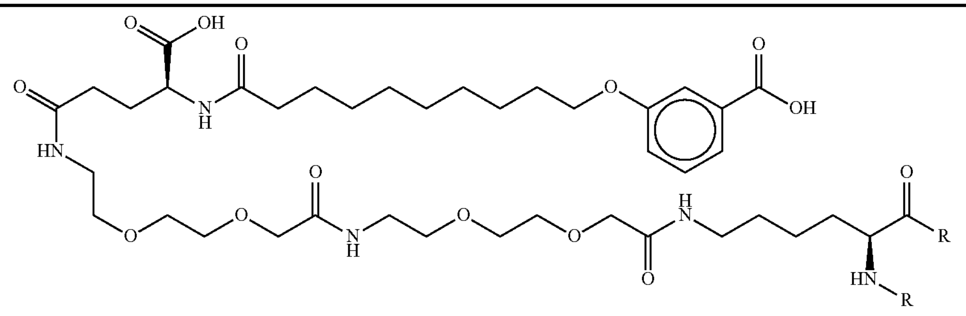 C40H63N5O14R2 K(PEG2PEG2gEmXOH) | | OC([C@@H](NC(CCCCCCCCCCO c1cccc(C(O)=O)c1)=O)CCC (NCCOCCOCC(NCCOCCOCC (NCCCC[C@H](N[R]) C([R])=O)=O)=O)=O)=O |
| 149 | 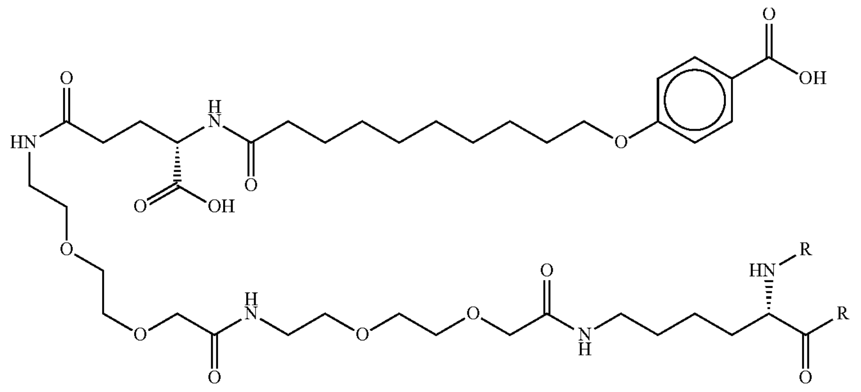 C40H63N5O14R2 K(PEG2PEG2gEpXOH) | | OC([C@@H](NC(CCCCCCCCCCO c1ccc(C(O)=O)cc1)=O)CCC (NCCOCCOCC(NCCOCCOCC (NCCCC[C@H](N [R])C([R])=O)=O)=O)=O)=O |

TABLE 2D-continued
| Peg Moeties and Peg Modified Monomers | | | |
|---|---|---|---|
| 1 | Structure | Names and Synonyms | Smiles Structure |
| 150 | 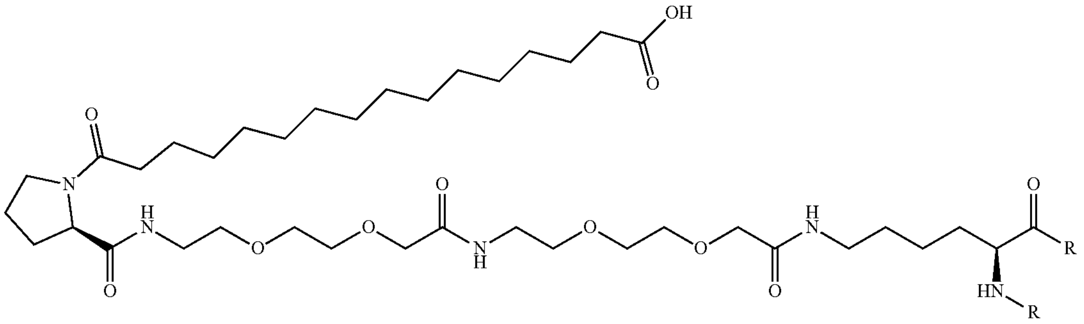<br>C41H73N5O11R2<br>K(PEG2PEG2pC18OH) | OC(CCCCCCCCCCCCCCCCC (N1CCC[C@@H]1C (NCCOCCOCC(NCCOCCOCC (NCCCC[C@H](N[R])C([R])= O)=O)=O)=O)=O)=O | |
| 151 | 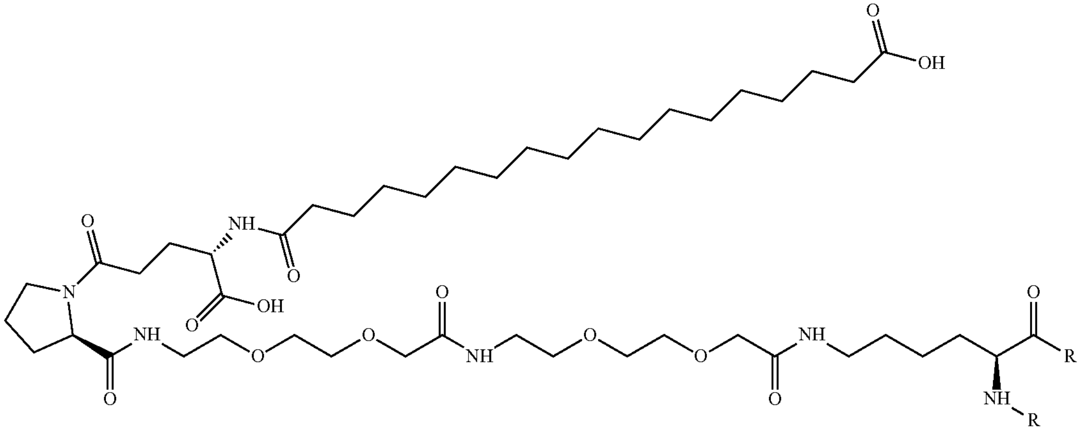<br>C46H80N6O14R2<br>K(PEG2PEG2pgEC18OH) | OC(CCCCCCCCCCCCCCCCC(N [C@@H](CCC(N(CCC1)[C@H]1C (NCCOCCOCC(NCCOCCOCC (NCCCC[C@@H](C([R])=O)N [R])=O)=O)=O)=O)C(O)=O)= O)=O | |

TABLE 2D-continued

| Peg Moeties and Peg Modified Monomers | | | |
|---|---|---|---|
| 1 | Structure | Names and Synonyms | Smiles Structure |
| 152 | 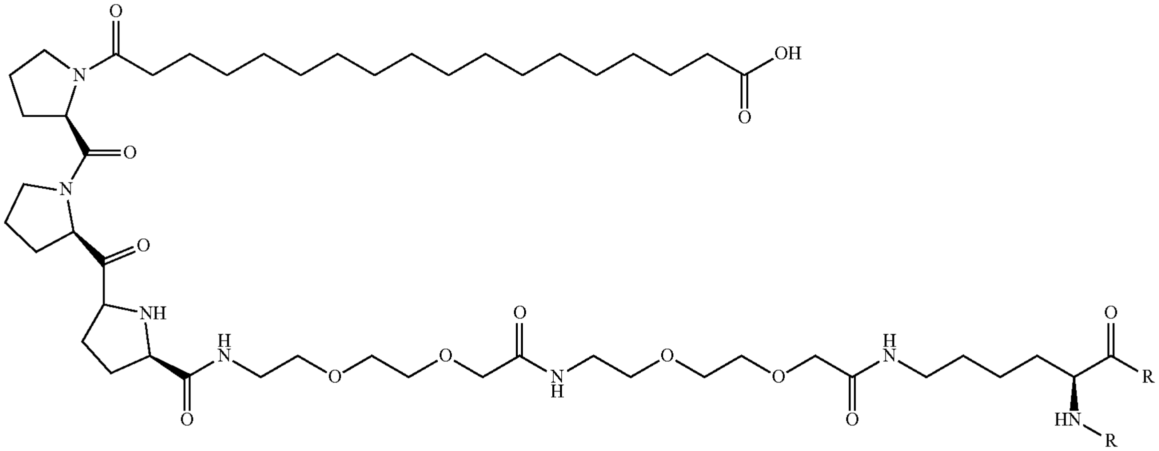<br>C51H87N7O13R2<br>K(PEG2PEG2pppC18OH) | | OC(CCCCCCCCCCCCCCCCC(N(CCC1)[C@H]1C(N(CCC1)[C@H]1C(N(CCC1)[C@H]1C(NCCOCCOCC(NCCOCCOCC(NCCCC[C@@H](C([R])=O)N[R])=O)=O)=O)=O)=O)=O)=O |
| 153 | 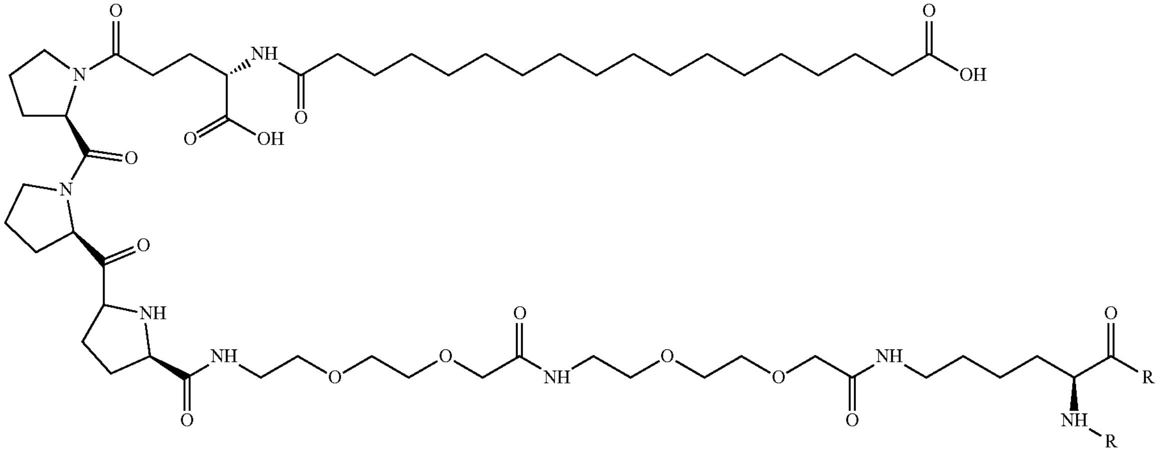 | | OC(CCCCCCCCCCCCCCCCC(N[C@@H](CCC(N(CCC1)[C@H]1C(N(CCC1)[C@H]1C(N(CCC1)[C@H]1C(NCCOCCOCC(NCCOCCOCC(NCCCC[C@@H](C([R])=O)N[R])=O)=O)=O)=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| | C56H94N8O16R2<br>K(PEG2PEG2pppgEC18OH) | | |
| 154 | 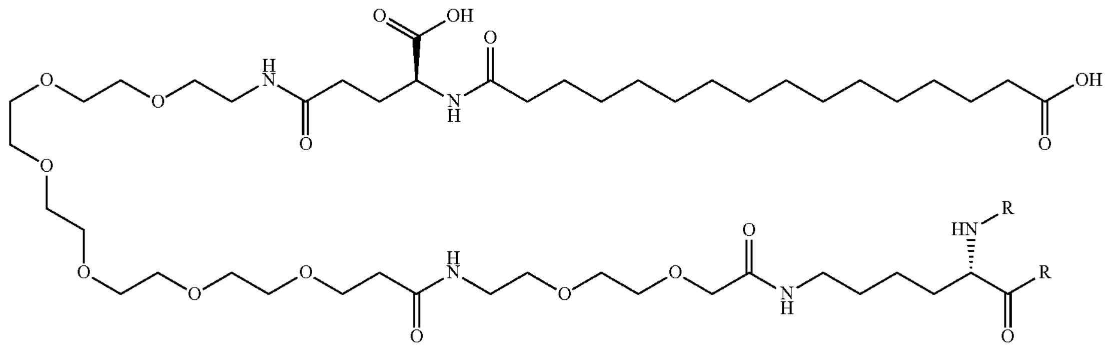<br>C48H87N5O17R2<br>K(PEG2PEG6gEC16OH) | | OC(CCCCCCCCCCCCCCC(N [C@@H](CCC(NCCOCCOCCO CCOCCOCCOCCC(NCCOCCOCC (NCCCC[C@@H](C([R])=O)N [R])=O)=O)=O)C(O)=O)=O)=O |
| 155 | 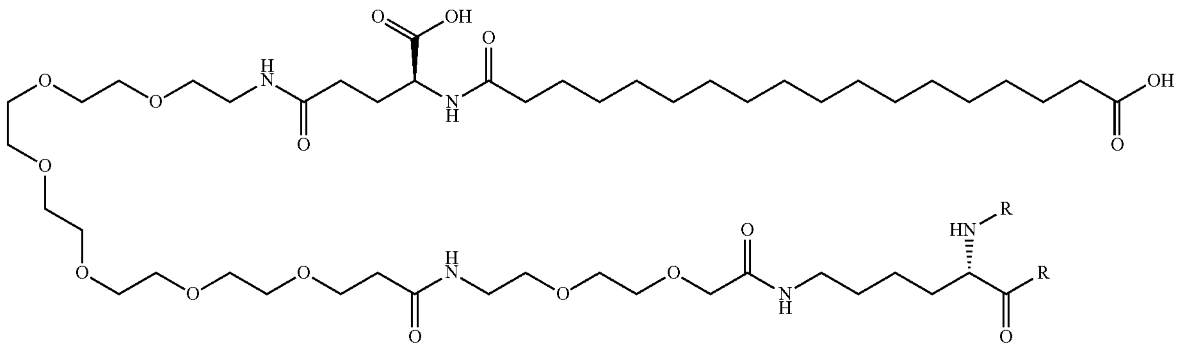<br>C50H91N5O17R2<br>K(PEG2PEG6gEC18OH) | | OC(CCCCCCCCCCCCCCCCC(N [C@@H](CCC(NCCOCCOCCOCCO CCOCCOCCC(NCCOCCOCC (NCCCC[C@@H](C([R])=O)N[R])= O)=O)=O)C(O)=O)=O)=O |

TABLE 2D-continued
| Peg Moeties and Peg Modified Monomers | | | |
|---|---|---|---|
| 1 | Structure | Names and Synonyms | Smiles Structure |
| 156 | 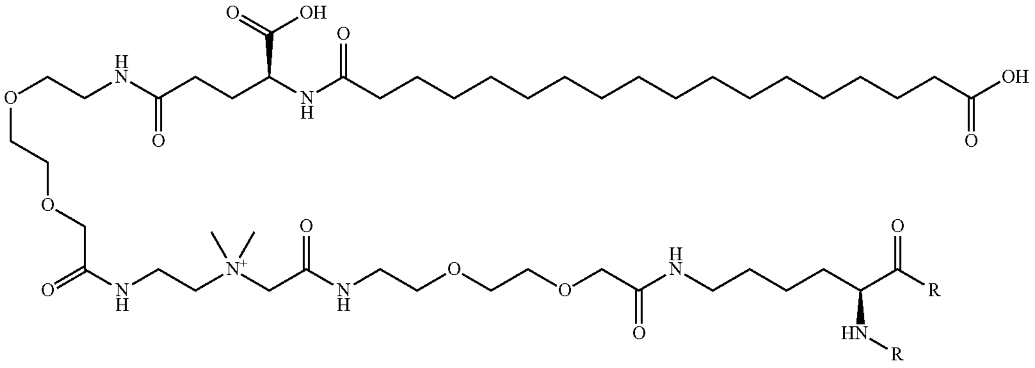<br>C47H86N7O14R2+<br>K(PEG2Sp6PEG2gEC18OH) | | C[N+](C)(CCNC(COCCOCCNC(CC[C@@H](C(O)=O)NC(CCCCCCCCCCCCCCCCC(O)=O)=O)=O)=O)CC(NCCOCCOCC(NCCCC[C@@H](C([R])=O)N[R])=O)=O |
| 157 | 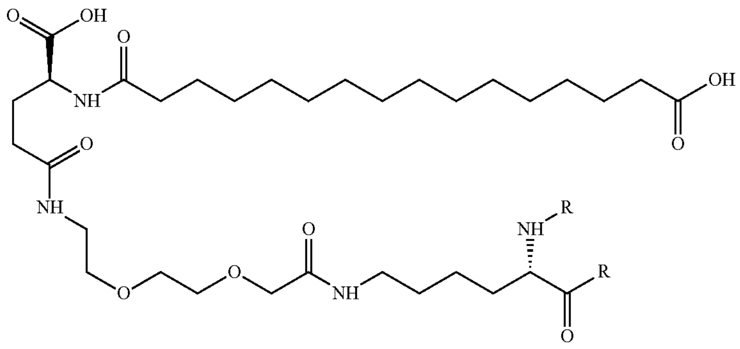<br>C33H58N4O10R2<br>K(PEG2gEC16OH) | | OC(CCCCCCCCCCCCCCC(N[C@@H](CCC(NCCOCCOCC(NCCCC[C@@H](C([R])=O)N[R])=O)=O)C(O)=O)=O)=O |

TABLE 2D-continued

Peg Moeties and Peg Modified Monomers

| 1 | Structure | Names and Synonyms | Smiles Structure |
|---|---|---|---|
| 158 | 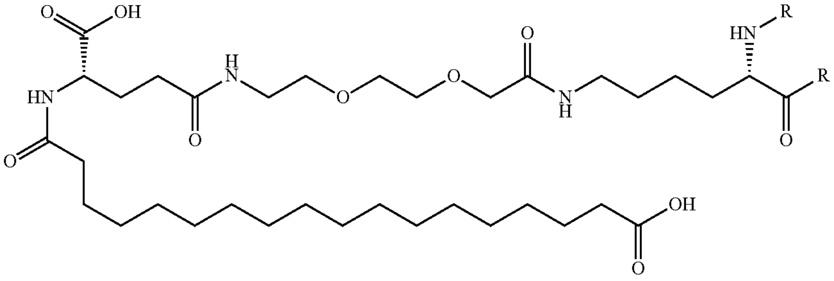<br>C35H62N4O10R2<br>K(PEG2gEC18OH) | OC(CCCCCCCCCCCCCCCCC(N[C@@H](CCC(NCCOCCOCC(NCCCC[C@@H](C([R])=O)N[R])=O)=O)C(O)=O)=O)=O | |
| 159 | 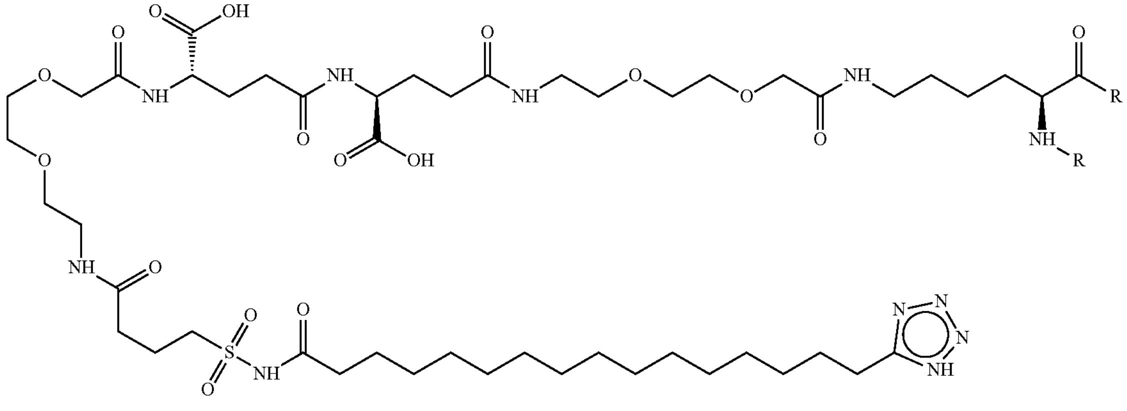<br>C49H85N11O17SR2<br>K(PEG2gEgEPEG24SBC16Tetrazole) | OC([C@H](CCC(NCCOCCOCC(NCCCC[C@@H](C([R])=O)N[R])=O)=O)NC(CC[C@@H](C(O)=O)NC(COCCOCCNC(CCCS(NC(CCCCCCCCCCCCCCCc1nnn[nH]1)=O)(=O)=O)=O)=O)=O)=O | |
| 160 | 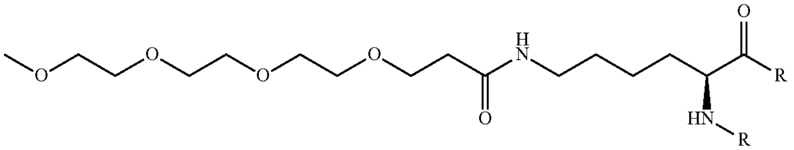 | COCCOCCOCCOCCC(NCCCC[C@@H](C([R])=O)N[R])=O | |

TABLE 2D-continued
| Peg Moeties and Peg Modified Monomers | | | |
|---|---|---|---|
| 1 | Structure | Names and Synonyms | Smiles Structure |
| | C16H30N2O6R2<br>K(PEG3OMe)<br>K(mPEG4) | | |
| 161 | 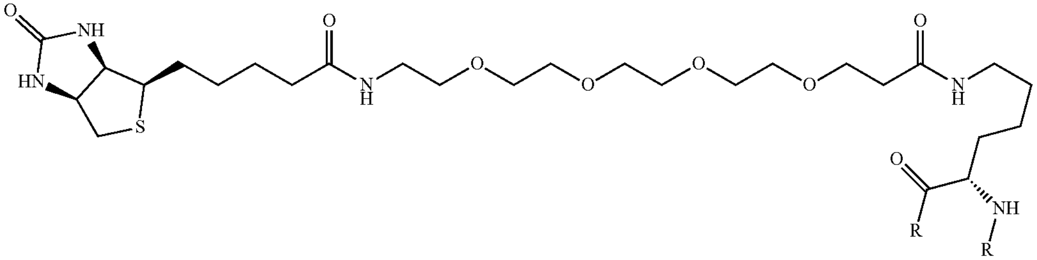 | | O=C(CCCC[C@H]([C@@H]1N2)SC[C@H]1NC2=O)NCCOCCOCCOCCOCCC(NCCCC[C@@H](C([R])=O)N[R])=O |
| | C27H47N5O8SR2<br>K(PEG4Biotina), K(PEG4Biotin) | | |
| 162 | 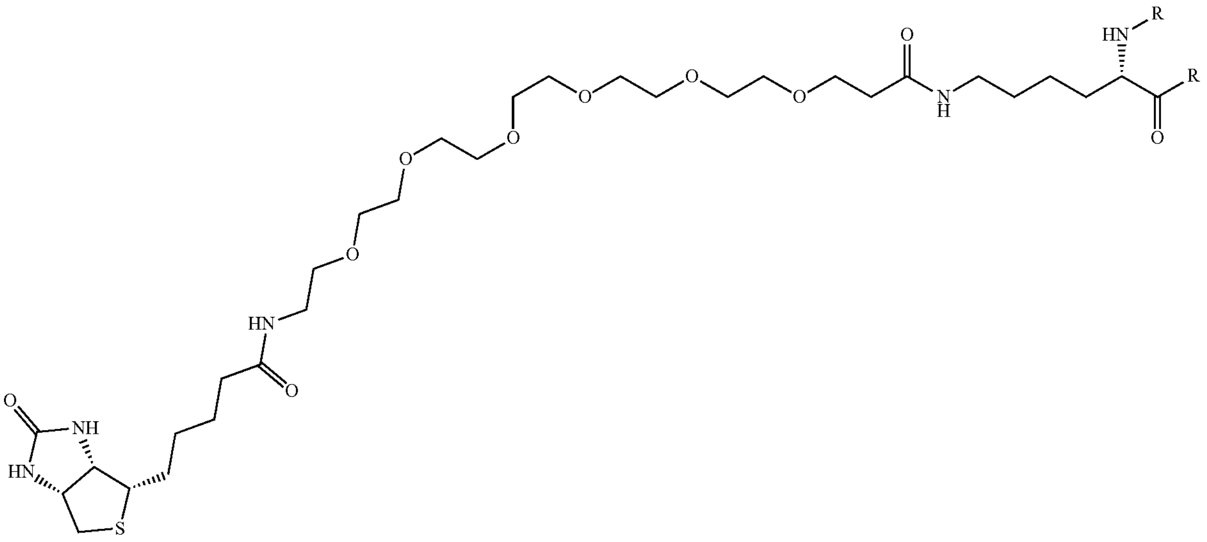 | | O=C(CCCC[C@@H]([C@H]1N2)SC[C@@H]1NC2=O)NCCOCCOCCOCCOCCOCCOCCC(NCCCC[C@@H](C([R])=O)N[R])=O |
| | C31H55N5O10SR2<br>K(PEG6Biotin) | | |

TABLE 2D-continued

| Peg Moeties and Peg Modified Monomers | | | |
|---|---|---|---|
| 1 | Structure | Names and Synonyms | Smiles Structure |
| 163 | 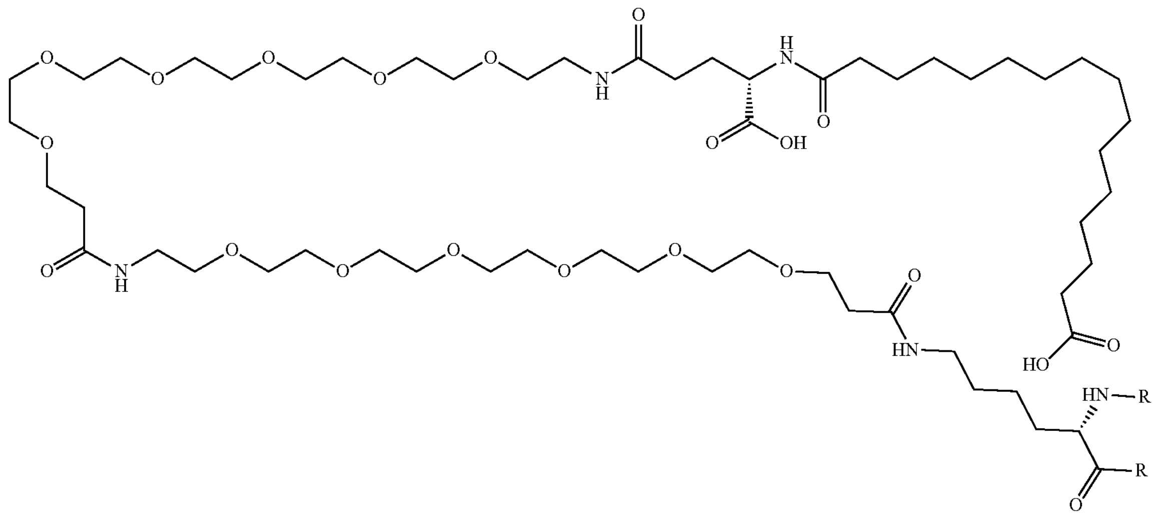<br>C57H105N5O21R2<br>K(PEG6PEG6gEC16OH) | | OC(CCCCCCCCCCCCCCC(N [C@@H](CCC(NCCOCCOCCO CCOCCOCCOCCC(NCCOCCO CCOCCOCCOCCOCCC(NCCCC [C@@H](C([R])=O)N[R])= O)=O)=O)C(O)=O)=O)=O |
| 164 | 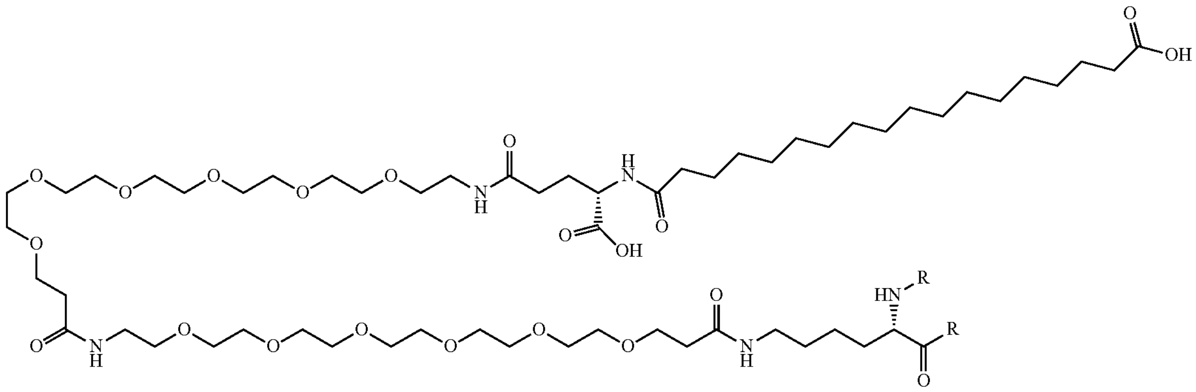 | | OC(CCCCCCCCCCCCCCCCCC(N [C@@H](CCC(NCCOCCOCCO CCOCCOCCOCCC(NCCOCCO CCOCCOCCOCCOCCC(NCCCC [C@@H](C([R])=O)N[R])=O)= O)=O)C(O)=O)=O)=O |

TABLE 2D-continued
| Peg Moeties and Peg Modified Monomers | | | |
|---|---|---|---|
| 1 | Structure | Names and Synonyms | Smiles Structure |
| | C59H109N5O21R2<br>K(PEG6PEG6gEC18OH) | | |
| 165 | 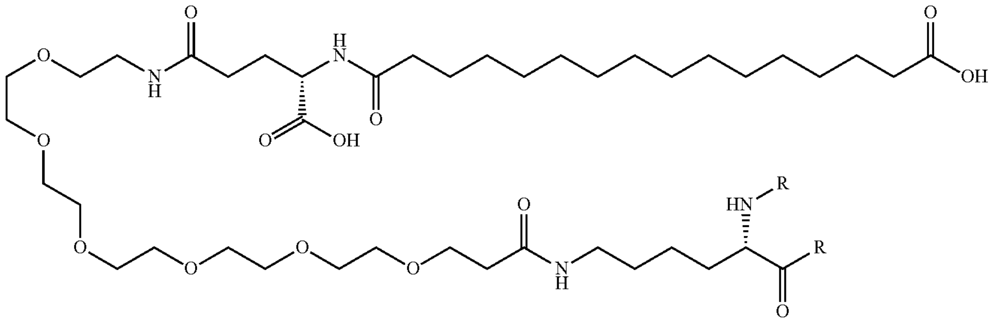 | | OC(CCCCCCCCCCCCCCCC(N[C@@H](CCC(NCCOCCOCCOCCOCCOCCOCCOCCC(NCCCC[C@@H](C([R])=O)N[R])=O)=O)C(O)=O)=O)=O |
| | C42H76N4O14R2<br>K(PEG6gEC16OH) | | |
| 166 | 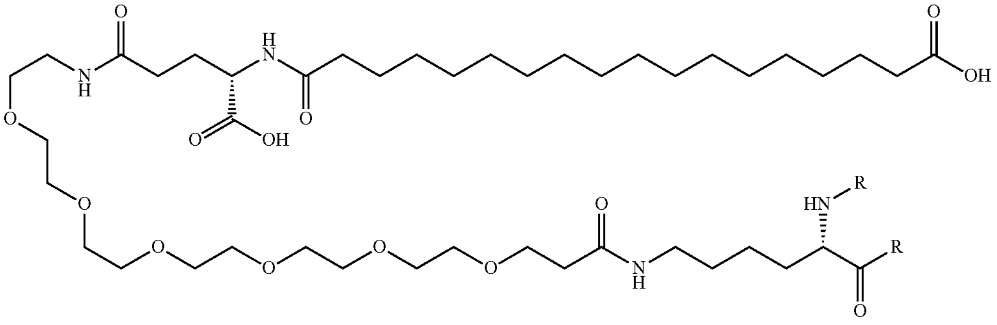 | | OC(CCCCCCCCCCCCCCCCCC(N[C@@H](CCC(NCCOCCOCCOCCOCCOCCOCCC(NCCCC[C@@H](C([R])=O)N[R])=O)=O)C(O)=O)=O)=O |
| | C44H80N4O14R2<br>K(PEG6gEC18OH) | | |

TABLE 2D-continued

| Peg Moeties and Peg Modified Monomers | | | |
|---|---|---|---|
| 1 | Structure | Names and Synonyms | Smiles Structure |
| 167 | 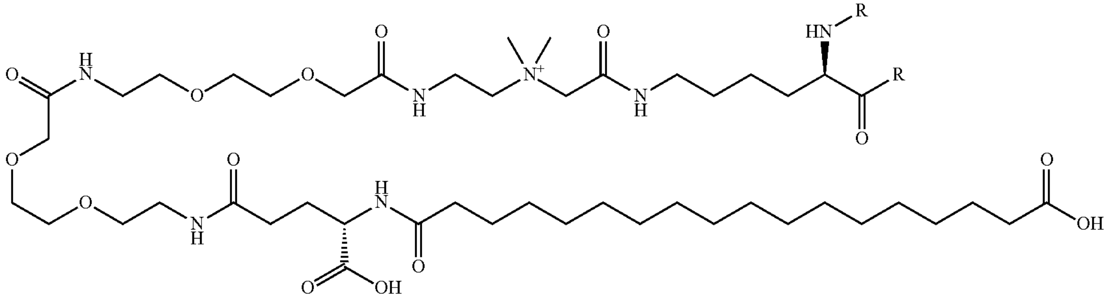<br>C47H86N7O14R2+<br>K(Sp6PEG2PEG2gEC18OH) | | C[N+](C)(CCNC(COCCOCCNC(COCCOCCNC(CC[C@@H](C(O)=O)NC(CCCCCCCCCCCCCCCCC(O)=O)=O)=O)=O)=O)CC(NCCCC[C@@H](C([R])=O)N[R])=O |
| 168 | 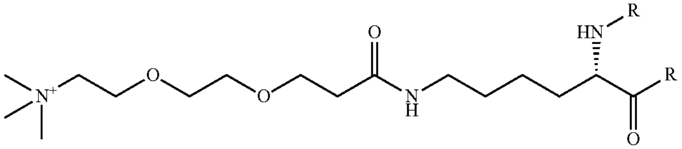<br>C16H32N3O4R2+<br>K(cPEG3a), K(cPEG3aCO) | | C[N+](C)(C)CCOCCOCCC(NCCCC[C@@H](C([R])=O)N[R])=O |
| 169 | 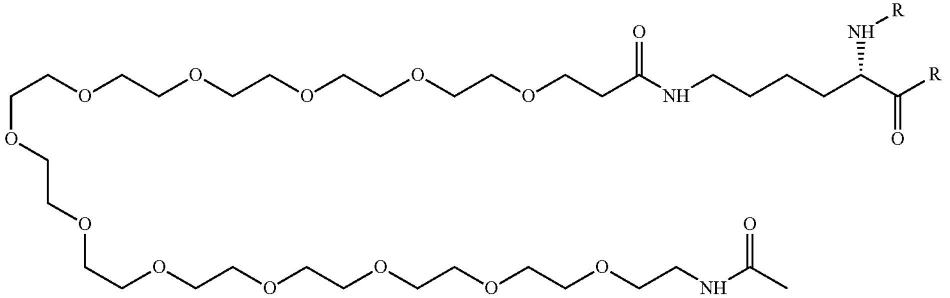<br>C35H67N3O15R2<br>K(dPEG12Ac) | | CC(NCCOCCOCCOCCOCCOCCOCCOCCOCCOCCOCCOCCC(NCCCC[C@@H](C([R])=O)N[R])=O)=O |

TABLE 2D-continued

Peg Moeties and Peg Modified Monomers

| 1 | Structure | Names and Synonyms | Smiles Structure |
|---|---|---|---|
| 170 | 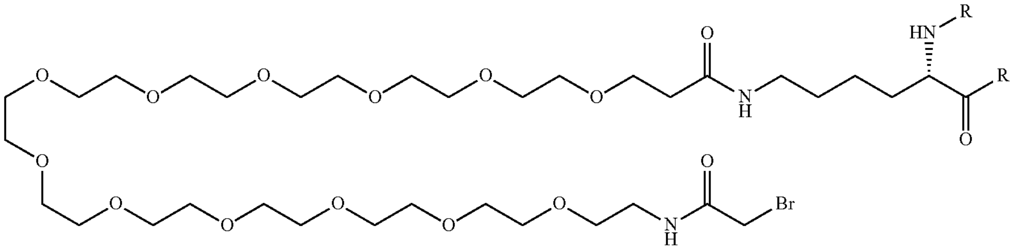<br>C35H66BrN3O15R2<br>K(dPEG12AcBr) | | O=C(CCOCCOCCOCCOCCOCCO CCOCCOCCOCCOCCOCCOCCNC (CBr)=O)NCCCC[C@@H](C([R])= O)N[R] |
| 171 | 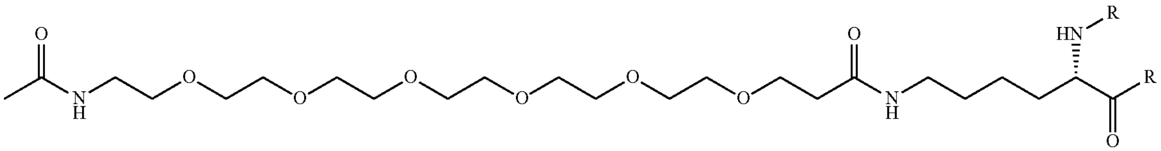<br>C23H43N3O9R2<br>K(dPEG6Ac) | | CC(NCCOCCOCCOCCOCCOCCO CCC(NCCCC[C@@H](C([R])=O) N[R])=O)=O |
| 172 | 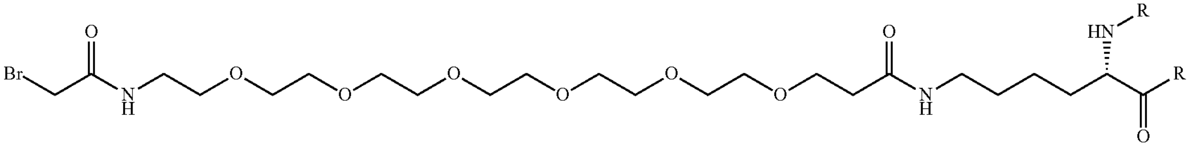<br>C23H42BrN3O9R2<br>K(dPEG6AcBr) | | O=C(CCOCCOCCOCCOCCOCCO CCNC(CBr)=O)NCCCC[C@@H] (C([R])=O)N[R] |

TABLE 2D-continued
| Peg Moeties and Peg Modified Monomers | | | |
|---|---|---|---|
| 1 | Structure | Names and Synonyms | Smiles Structure |
| 173 | 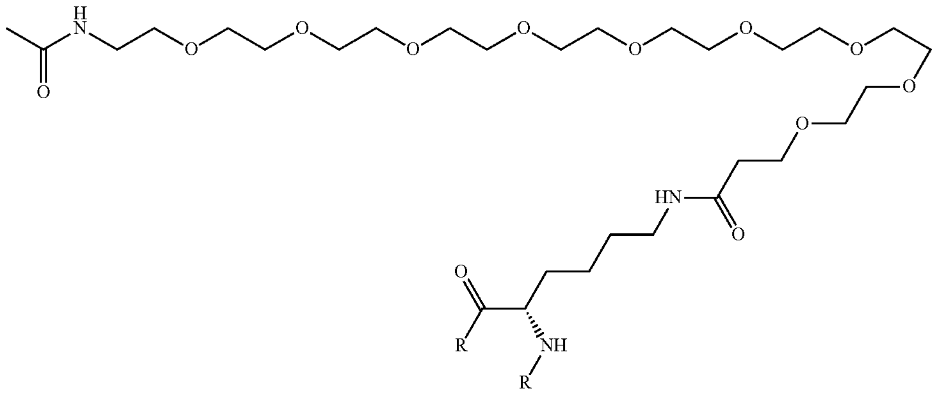 C29H55N3O12R2 K(dPEG9Ac) | | CC(NCCOCCOCCOCCOCCOCC OCCOCCOCCOCCC(NCCCC [C@@H](C([R])=O)N[R])=O)=O |
| 174 | 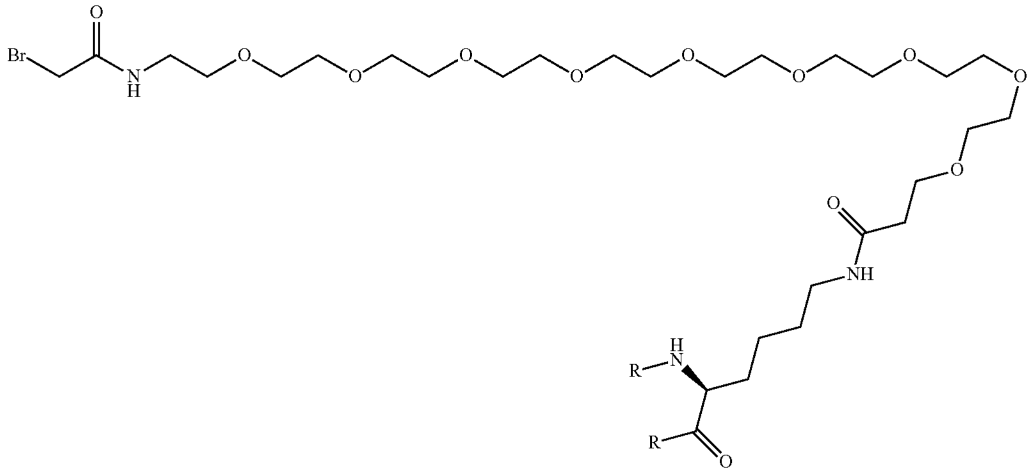 C29H54BrN3O12R2 K(dPEG9AcBr) | | O=C(CCOCCOCCOCCOCCOCCO CCOCCOCCOCCNC(CBr)=O) NCCCC[C@@H](C([R])=O)N[R] |

TABLE 2D-continued

| Peg Moeties and Peg Modified Monomers | | | |
|---|---|---|---|
| 1 | Structure | Names and Synonyms | Smiles Structure |
| 175 | 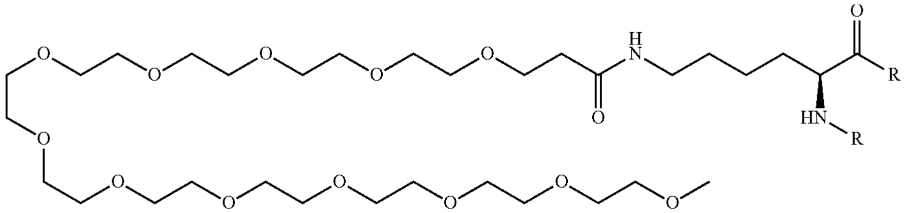 C32H62N2O14R2 K(mPEG12) | | COCCOCCOCCOCCOCCOCCO CCOCCOCCOCCOCCOCCC (NCCCC[C@@H](C([R])=O)N [R])=O |
| 176 | 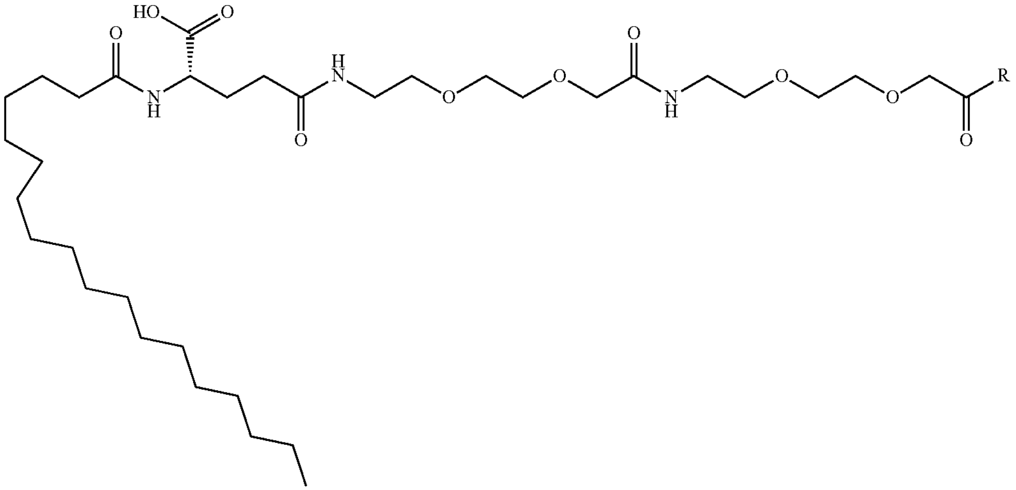 C35H64N3O10R PEG2PEG2gEC18 | | CCCCCCCCCCCCCCCCCC(N [C@@H](CCC(NCCOCCOCC (NCCOCCOCC([R])=O)=O)=O) C(O)=O)=OCCCCCCCCCCCCCC CCCCC(N[C@@H](CCC(NCCOC COCC(NCCOCCOCC=O)=O)=O) C(O)=O)=O |
| 177 | 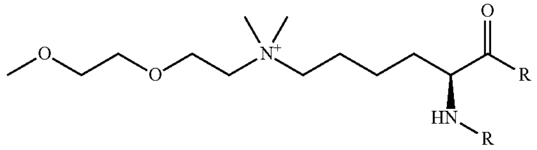 | | C[N+](C)(CCCC[C@@H](C([R])=O) N[R])CCOCCOC |

TABLE 2D-continued
| Peg Moeties and Peg Modified Monomers | | | |
|---|---|---|---|
| 1 | Structure | Names and Synonyms | Smiles Structure |
| | C13H27N2O3R2+<br>Lys(N+Me2mPEG3) | | |
| 178 | 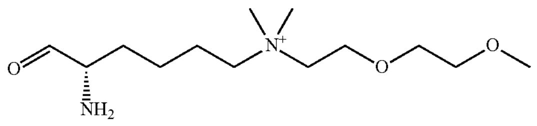 [SMILES: COCCOCC[N+](C)(C)CCCC[C@H](N)C=O]<br>C13H29N2O3+<br>LysQuatMe2mPEG3, Lys(N+(Me)2mPEG3) | | C[N+](C)(CCCC[C@@H](C=O)N)CCOCCOC |
| 180 | 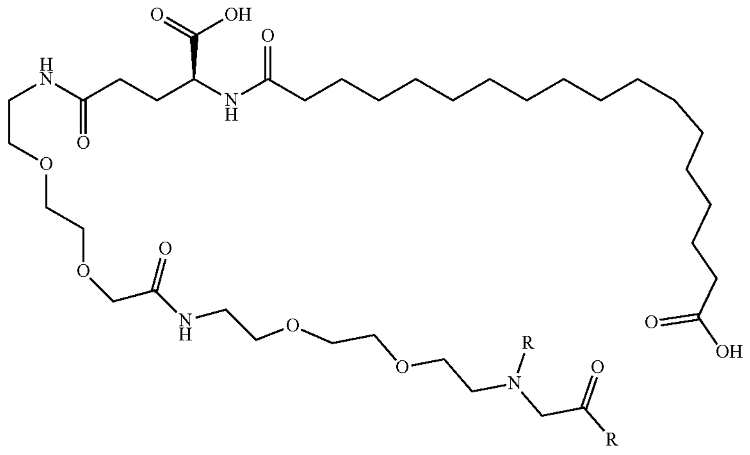<br>C37H66N4O12R2<br>N(PEG2PEG2gEC18OH)Gly | | OC(CCCCCCCCCCCCCCCCCC(N[C@@H](CCC(NCCOCCOCC(NCCOCCOCCN(CC([R])=O)[R])=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 181 | 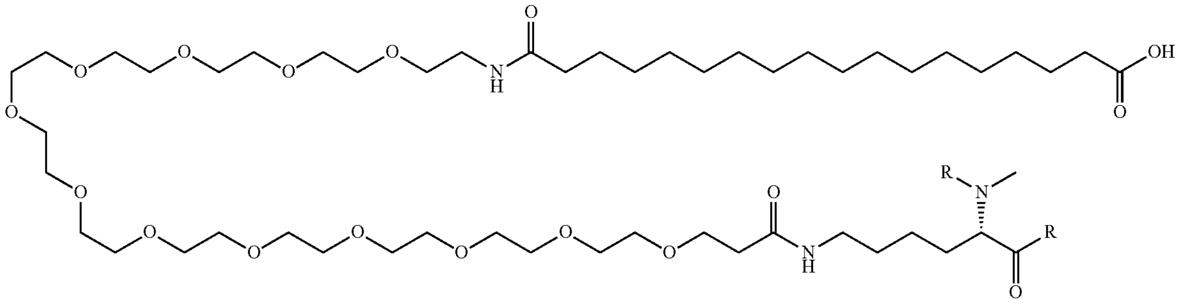<br>C52H99N3O17R2<br>NMeK(PEG12C18OH) | | CN([C@@H](CCCCNC(CCOCCOCCOCCOCCOCCOCCOCCOCCOCCOCCOCCOCCOCCNC(CCCCCCCCCCCCCCCCC(O)=O)=O)=O)C([R])=O)[R] |
| 182 | 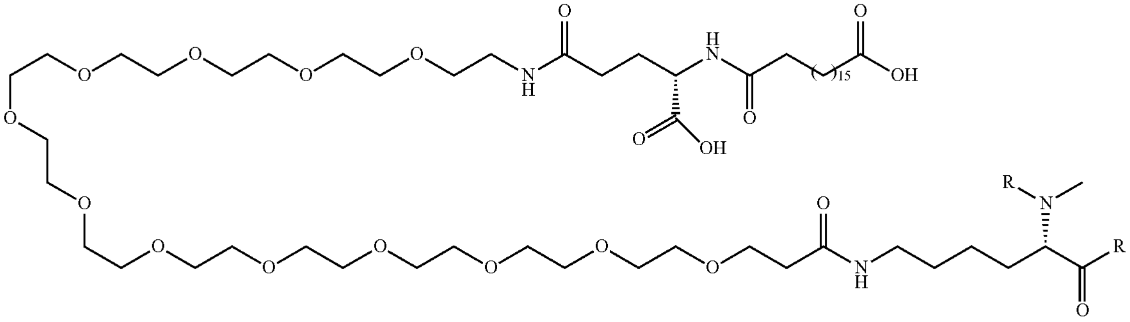<br>C57H106N4O20R2<br>NMeK(PEG12gEC18OH) | | CN([C@@H](CCCCNC(CCOCCOCCOCCOCCOCCOCCOCCOCCOCCOCCOCCOCCOCCNC(CC[C@@H](C(O)=O)NC(CCCCCCCCCCCCCCCCC(O)=O)=O)=O)=O)C([R])=O)[R] |

TABLE 2D-continued
| Peg Moeties and Peg Modified Monomers | | | |
|---|---|---|---|
| 1 | Structure | Names and Synonyms | Smiles Structure |
| 183 | 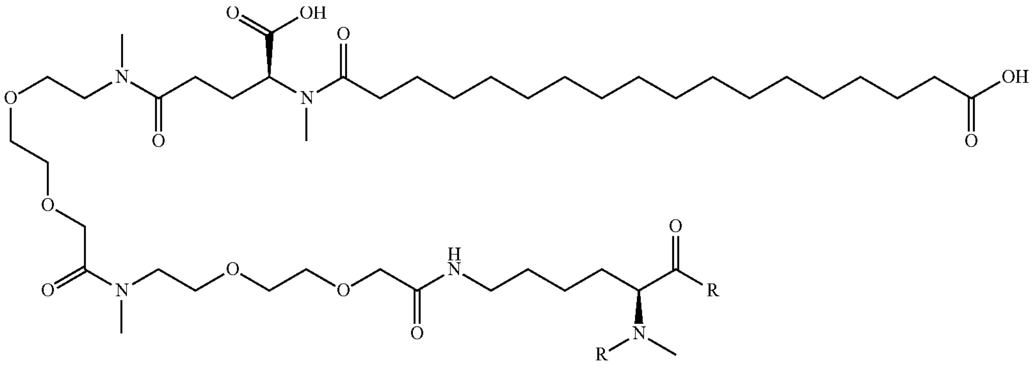 C45H81N5O13R2 NMeK(PEG2NMePEG2NMegENMeC18OH) | | CN(CCOCCOCC(N(C)CCOCCOCC(NCCCC[C@@H](C([R])=O)N(C)[R])=O)=O)C(CC[C@@H](C(O)=O)N(C)C(CCCCCCCCCCCCCCCCC(O)=O)=O)=O |
| 184 | 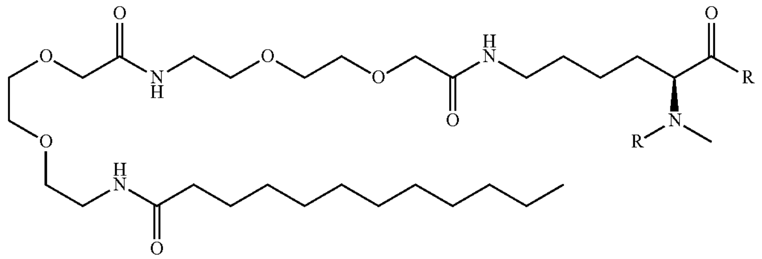 C31H58N4O8R2 NMeK(PEG2PEG2C12) | | CCCCCCCCCCCC(NCCOCCOCC(NCCOCCOCC(NCCCC[C@@H](C([R])=O)N(C)[R])=O)=O)=O |

TABLE 2D-continued
| Peg Moeties and Peg Modified Monomers | | | |
|---|---|---|---|
| 1 | Structure | Names and Synonyms | Smiles Structure |
| 185 | 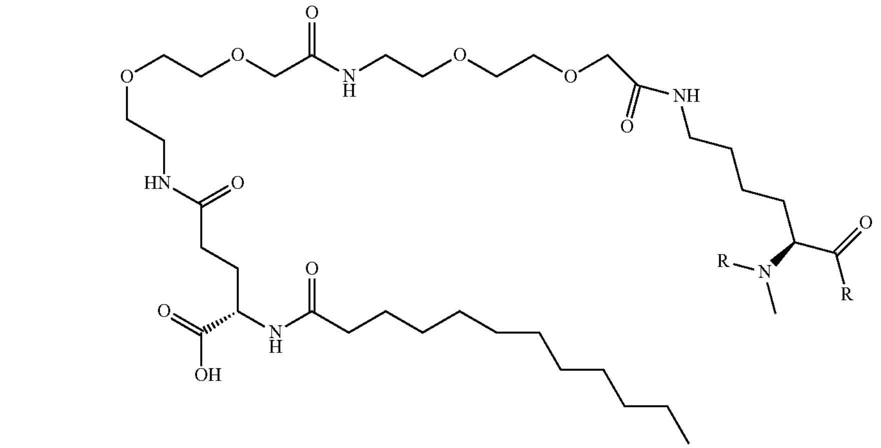<br>C36H65N5O11R2<br>NMeK(PEG2PEG2gEC12) | | CCCCCCCCCCCC(N[C@@H](CCC<br>(NCCOCCOCC(NCCOCCOCC(NCC<br>CC[C@@H](C([R])=O)N(C)[R])=<br>O)=O)=O)C(O)=O)=O |
| 186 | 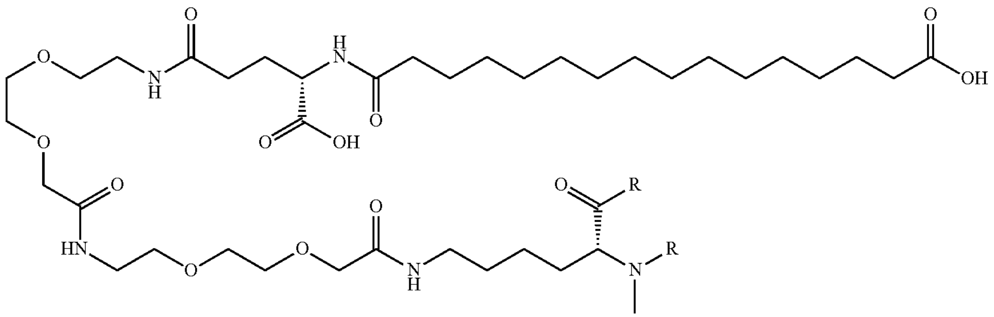<br>C40H71N5O13R2<br>NMeK(PEG2PEG2gEC16OH) | | CN([C@@H](CCCCNC(COCCOC<br>CNC(COCCOCCNC(CC[C@@H]<br>(C(O)=O)NC(CCCCCCCCCCCC<br>CCCC(O)=O)=O)=O)=O)=O)<br>C([R])=O)[R] |

TABLE 2D-continued
| Peg Moeties and Peg Modified Monomers | | | |
|---|---|---|---|
| 1 | Structure | Names and Synonyms | Smiles Structure |
| 187 | 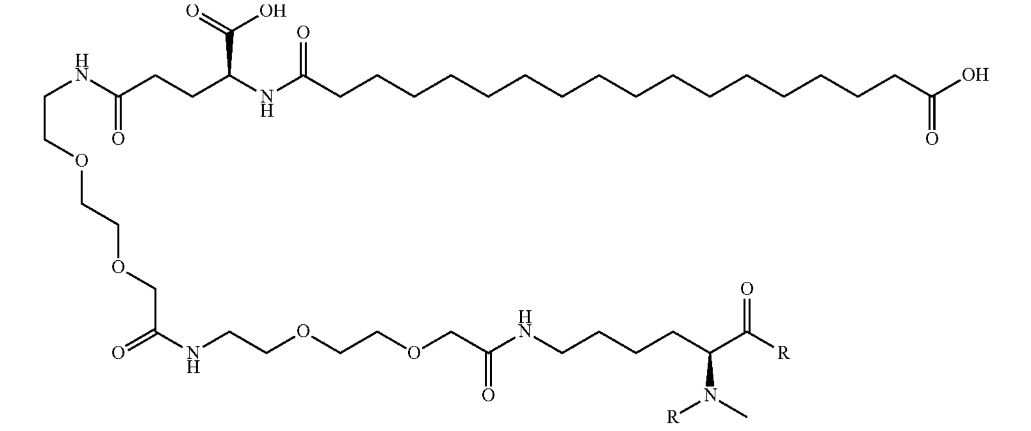<br>C42H75N5O13R2<br>NMeK(PEG2PEG2gEC18OH) | CN([C@@H](CCCCNC(COCCOC CNC(COCCOCCNC(CC[C@@H] (C(O)=O)NC(CCCCCCCCCCCCC CCCC(O)=O)=O)=O)=O)=O) C([R])=O)[R] | |
| 188 | 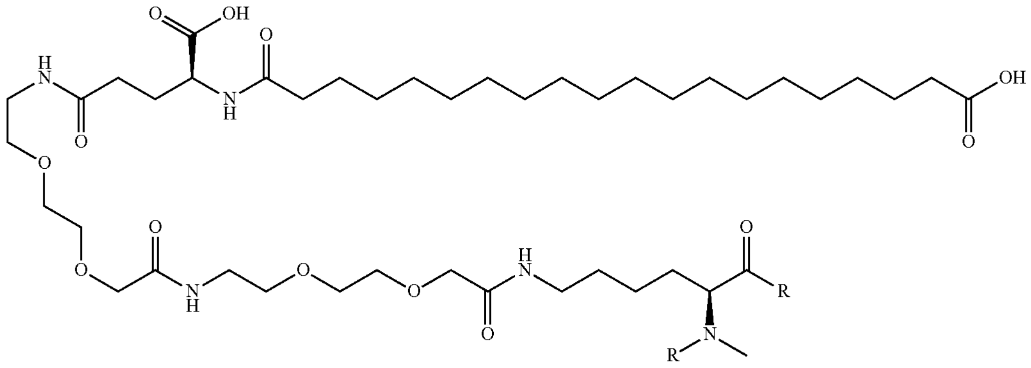<br>C44H79N5O13R2<br>NMeK(PEG2PEG2gEC20OH) | CN([C@@H](CCCCNC(COCCOC CNC(COCCOCCNC(CC[C@@H] (C(O)=O)NC(CCCCCCCCCCCC CCCCCCC(O)=O)=O)=O)=O)=O) C([R])=O)[R] | |

TABLE 2D-continued
| Peg Moeties and Peg Modified Monomers | | | |
|---|---|---|---|
| 1 | Structure | Names and Synonyms | Smiles Structure |
| 189 | 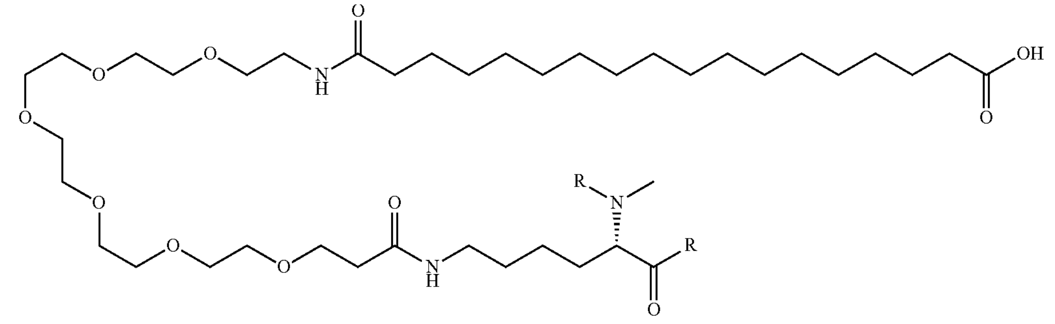<br>C39H74N3O11R3<br>NMeK(PEG6C18OH) | CN([R])[R](CCCCNC(CCOCCO CCOCCOCCOCCOCCNC (CCCCCCCCCCCCCCC CCC(O)=O)=O)=O)C([R])=O | |
| 190 | 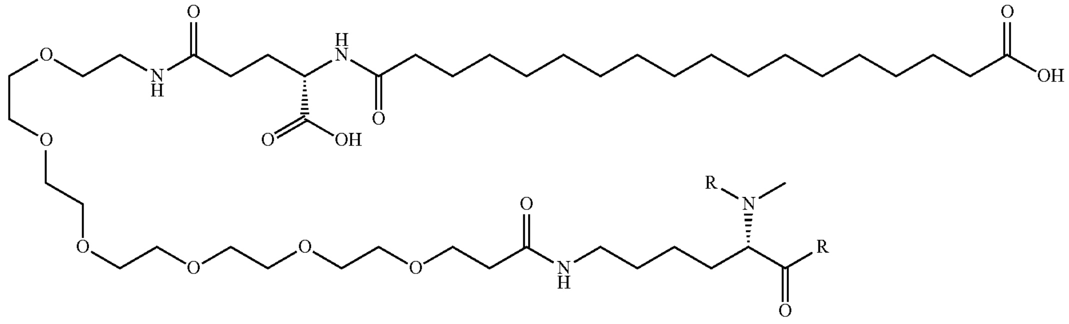<br>C45H82N4O14R2<br>NMeK(PEG6gEC18OH) | CN([C@@H](CCCCNC(CCOCCOCC OCCOCCOCCOCCNC(CC[C@@H] (C(O)=O)NC(CCCCCCCCCCCCCCCC CC(O)=O)=O)=O)=O)C([R])=O)[R] | |

TABLE 2D-continued
| Peg Moeties and Peg Modified Monomers | | | |
|---|---|---|---|
| 1 | Structure | Names and Synonyms | Smiles Structure |
| 191 | 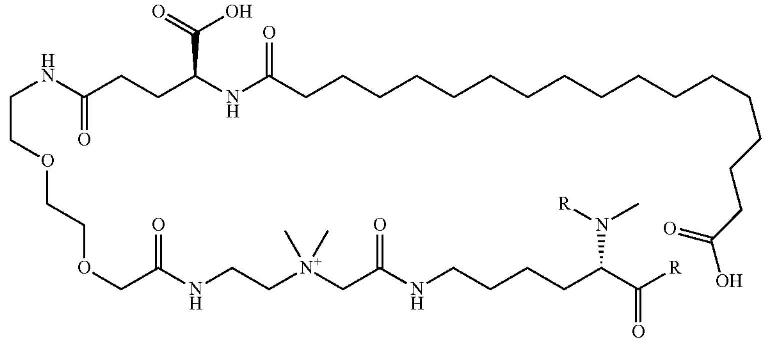 C42H77N6O11R2+ NMeK(SP6PEG2gEC18OH) | | CN([C@@H](CCCCNC(C[N+](C)(C)CCNC(COCCOCCNC(CC[C@@H](C(O)=O)NC(CCCCCCCCCCCCCCCCC(O)=O)=O)=O)=O)=O)C([R])=O)[R] |
| 192 | 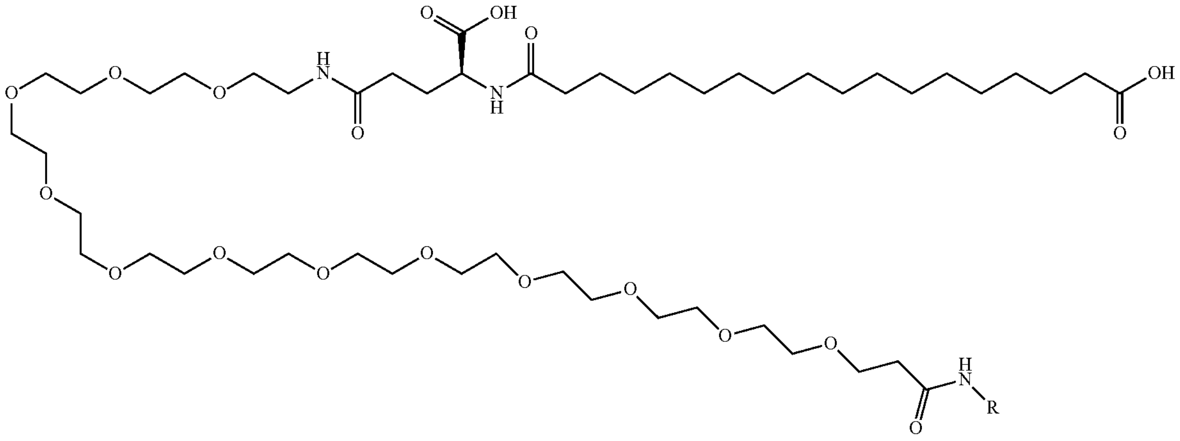 C50H94N3O19R PEG12gEC18OH | | OC(CCCCCCCCCCCCCCCCC(N[C@@H](CCC(NCCOCCOCCOCCOCCOCCOCCOCCOCCOCCOCCOCCOCCC(N[R])=O)=O)C(O)=O)=O)=O |

TABLE 2D-continued
| Peg Moeties and Peg Modified Monomers | | | |
|---|---|---|---|
| 1 | Structure | Names and Synonyms | Smiles Structure |
| 193 | 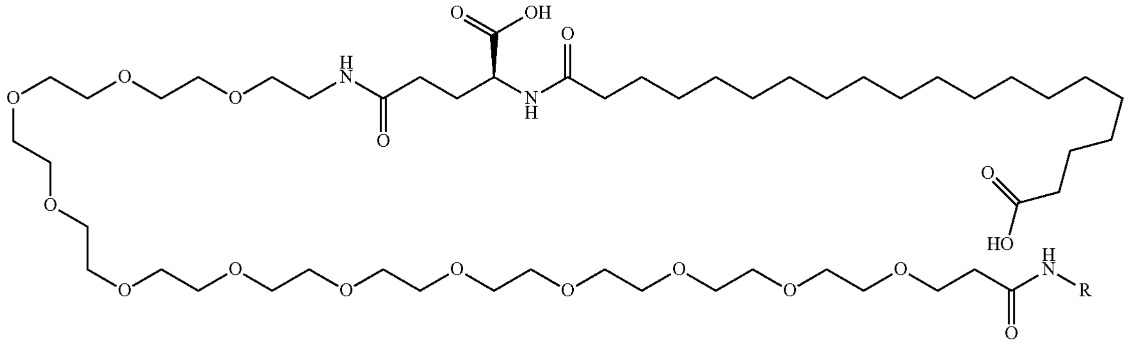 | C52H98N3O19R<br>PEG12gEC20OH | OC(CCCCCCCCCCCCCCCCCCC(N[C@@H](CCC(NCCOCCOCCOCCOCCOCCOCCOCCOCCOCCOCCOCCOCCC(N[R])=O)=O)C(O)=O)=O)=O |
| 194 | 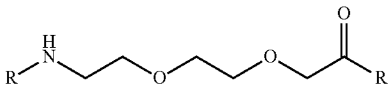 | C6H11NO3R2<br>PEG2, PEG2(2) | O=C(COCCOCCN[R])[R] |
| 195 | 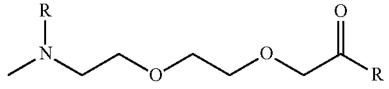 | C7H13NO3R2<br>PEG2(NMe(2))<br>PEG2NMe | CN(CCOCCOCC([R])=O)[R] |

TABLE 2D-continued

| Peg Moeties and Peg Modified Monomers | | | |
|---|---|---|---|
| 1 | Structure | Names and Synonyms | Smiles Structure |
| 196 | 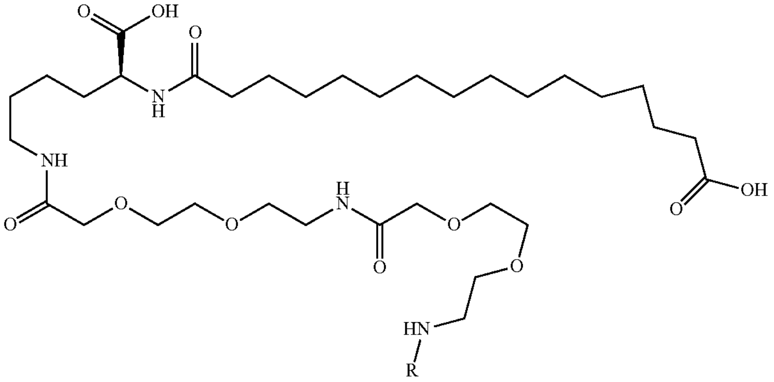<br>C34H63N4O11R<br>PEG2PEG2eKC16OH | | OC(CCCCCCCCCCCCCCC(N[C@@H](CCCCNC(COCCOCCNC(COCCOCCN[R])=O)=O)C(O)=O)=O)=ONCCOCCOCC(NCCOCCOCC(NCCCC[C@@H](C(O)=O)NC(CCCCCCCCCCCCCCC(O)=O)=O)=O)=O |
| 197 | 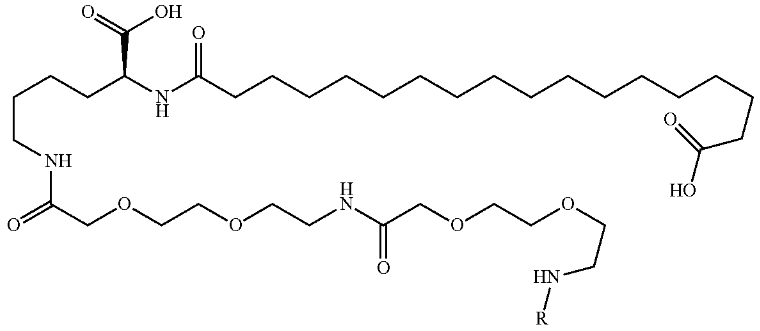<br>C36H67N4O11R<br>PEG2PEG2eKC18OH | | OC(CCCCCCCCCCCCCCCCC(N[C@@H](CCCCNC(COCCOCCNC(COCCOCCN[R])=O)=O)C(O)=O)=O)=ONCCOCCOCC(NCCOCCOCC(NCCCC[C@@H](C(O)=O)NC(CCCCCCCCCCCCCCCCC(O)=O)=O)=O)=O |

TABLE 2D-continued

| Peg Moeties and Peg Modified Monomers | | | |
|---|---|---|---|
| 1 | Structure | Names and Synonyms | Smiles Structure |
| 198 | 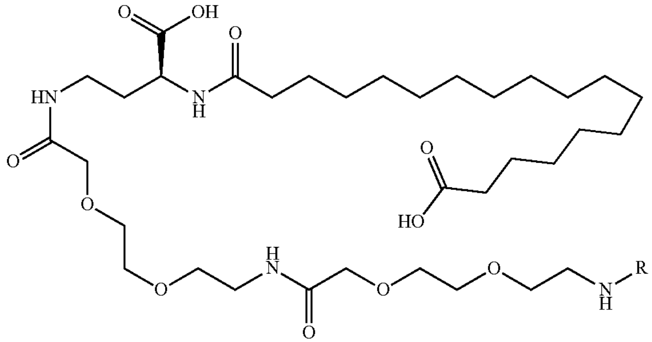<br>C34H63N4O11R<br>PEG2PEG2gDabC18OH | OC(CCCCCCCCCCCCCCCCC(N<br>[C@@H](CCNC(COCCOCCNC<br>(COCCOCCN[R])=O)=O)C<br>(O)=O)=O)=O<br>NCCOCCOCC(NCCOCCOCC(NCC<br>[C@@H](C(O)=O)NC(CCCCCCCCC<br>CCCCCCCCC(O)=O)=O)=O)=O | |
| 199 | 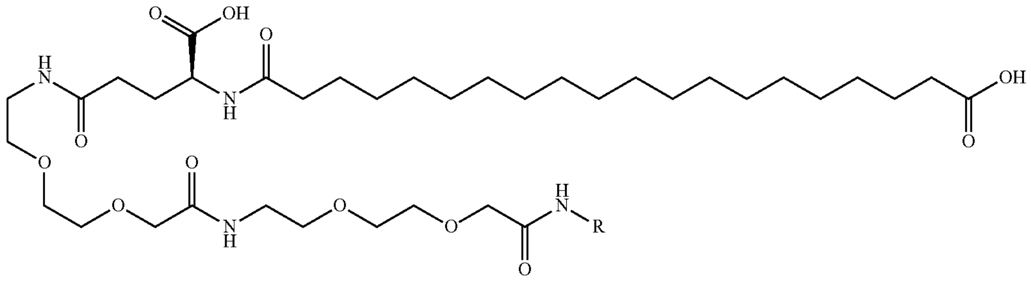<br>C37H67N4O12R<br>PEG2PEG2gEC20OH | OC(CCCCCCCCCCCCCCCCCCC<br>(N[C@@H](CCC(NCCOCCOCC<br>(NCCOCCOCC(N[R])=O)=O)=O)<br>C(O)=O)=O)=O | |
| 200 | 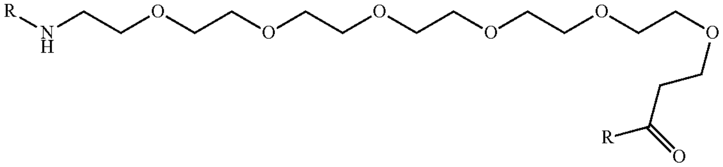<br>C15H29NO7R2<br>PEG6 | O=C(CCOCCOCCOCCOCCOCCO<br>CCN[R])[R] | |

TABLE 2D-continued
| Peg Moeties and Peg Modified Monomers | | | |
|---|---|---|---|
| 1 | Structure | Names and Synonyms | Smiles Structure |
| 201 | 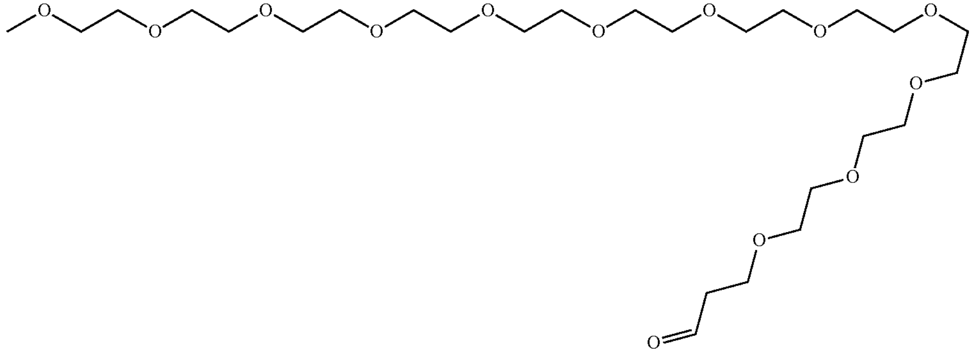 [SMILES: COCCOCCOCCOCCOCCOCCOCCOCCOCCOCCOCCOCCC=O]<br>C26H52O13<br>Peg12-Ome<br>Peg12OMe, Polyethylene12-O-Methyl<br>Peg12-O methyl | | COCCOCCOCCOCCOCCOCCOCCO CCOCCOCCOCCOCCC=O |
| 202 | 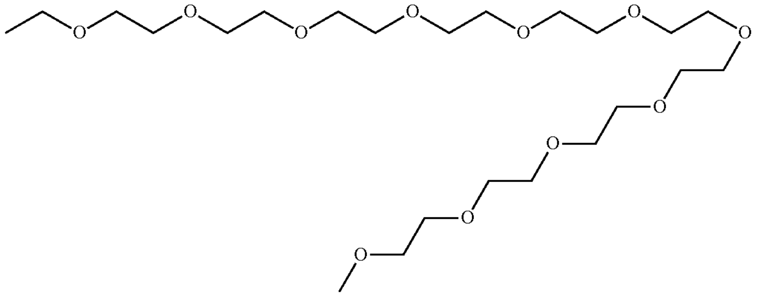 [SMILES: CCOCCOCCOCCOCCOCCOCCOCCOCCOCCOCCOC]<br>C23H48O11<br>Peg12OMe, Peg12-Omethyl | | CCOCCOCCOCCOCCOCCOCCOCC OCCOCCOCCOC |

TABLE 2D-continued

| Peg Moeties and Peg Modified Monomers | | | |
|---|---|---|---|
| 1 | Structure | Names and Synonyms | Smiles Structure |
| 203 | 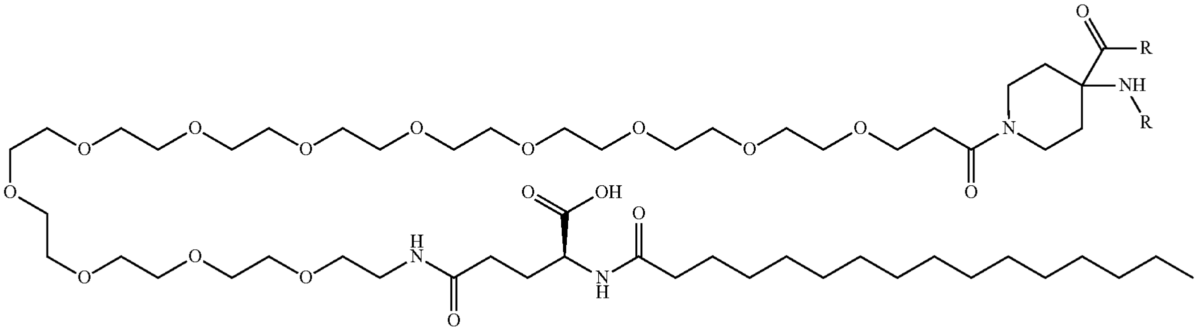 C54H100N4O18R2 Pip(PEG12gEC16), Spiral_Pip_PEG12_IsoGlu_Palm | | CCCCCCCCCCCCCCCC(N[C@@H](CCC(NCCOCCOCCOCCOCCOCCOCCOCCOCCOCCOCCOCCOCCC(N(CC1)CCC1(C([R])=O)N[R])=O)=O)C(O)=O)=O |
| 204 | 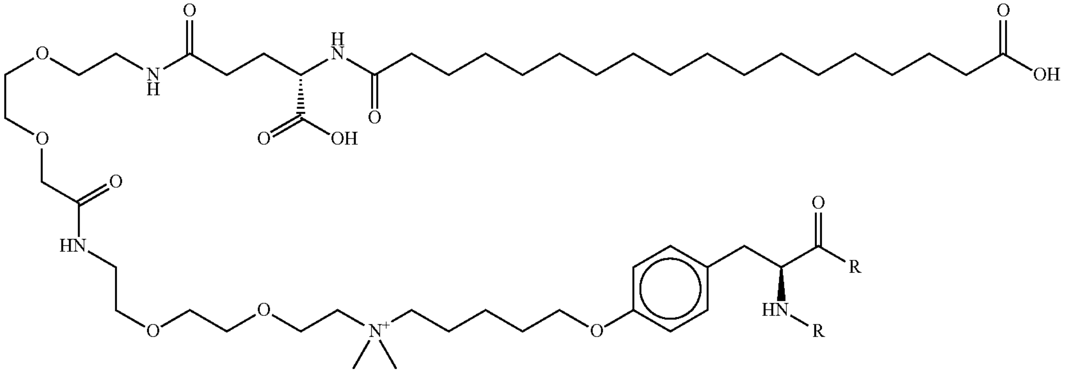 C51H88N5O13R2+ TMAPF(PEG2PEG2gEC18OH) | | C[N+](C)(CCCCCOc1ccc(C[C@@H](C([R])=O)N[R])cc1)CCOCCOCCNC(COCCOCCNC(CC[C@@H](C(O)=O)NC(CCCCCCCCCCCCCCCCC(O)=O)=O)=O)=O |
| 205 | 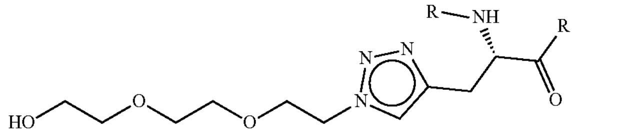 | | OCCOCCOCCn1nnc(C[C@@H](C([R])=O)N[R])c1 |

TABLE 2D-continued

| Peg Moeties and Peg Modified Monomers | | | |
|---|---|---|---|
| 1 | Structure | Names and Synonyms | Smiles Structure |
| | C11H18N4O4R2<br>Tzl(PEG3OH) | | |
| 206 | 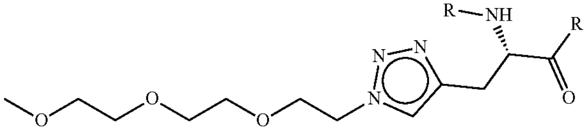<br>C12H20N4O4R2<br>Tzl(mPEG3) | | COCCOCCOCCn1nnc(C[C@@H](C([R])=O)N[R])c1 |
| 207 | 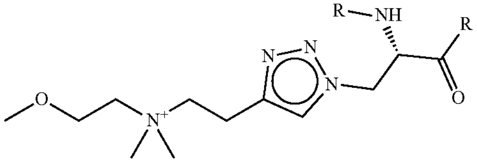<br>C12H22N5O2R2+<br>TzlChmPEG | | C[N+](C)(CCc1cn(C[C@@H](C([R])=O)N[R])nn1)CCOC |
| 208 | 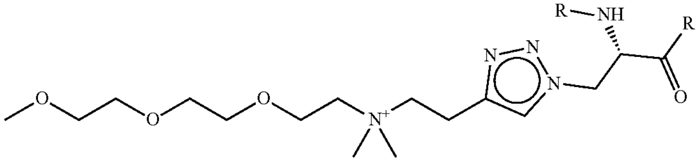<br>C16H30N5O4R2+<br>TzlChmPEG3 | | C[N+](C)(CCc1cn(C[C@@H](C([R])=O)N[R])nn1)CCOCCOCCOC |
| 209 | 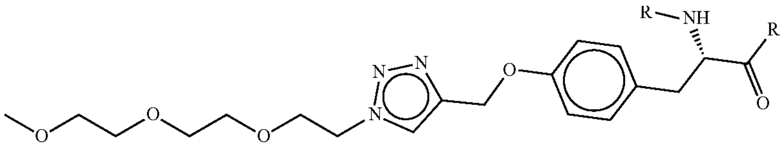<br>C19H26N4O5R2<br>Y(OTzl(mPEG3)) | | COCCOCCOCCn1nnc(COc2ccc(C[C@@H](C([R])=O)N[R])cc2)c1 |

TABLE 2D-continued
| Peg Moeties and Peg Modified Monomers | | | |
|---|---|---|---|
| 1 | Structure | Names and Synonyms | Smiles Structure |
| 210 | 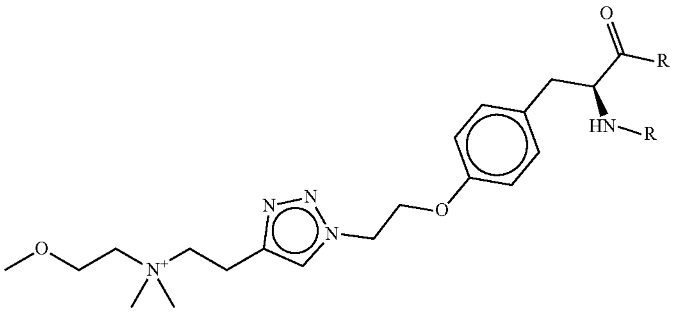<br>C20H30N5O3R2+<br>Y(OTzlChmPEG) | | C[N+](C)(CCc1cn(CCOc2ccc(C[C@@H](C([R])=O)N[R])cc2)nn1)CCOC |
| 211 | 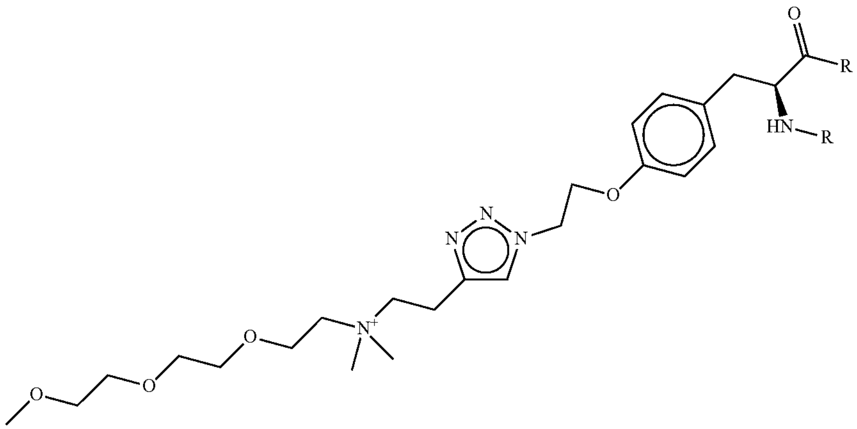<br>C24H38N5O5R2+<br>Y(OTzlChmPEG3) | | C[N+](C)(CCc1cn(CCOc2ccc(C[C@@H](C([R])=O)N[R])cc2)nn1)CCOCCOCCOC |

TABLE 2D-continued
| Peg Moeties and Peg Modified Monomers | | | |
|---|---|---|---|
| 1 | Structure | Names and Synonyms | Smiles Structure |
| 212 | 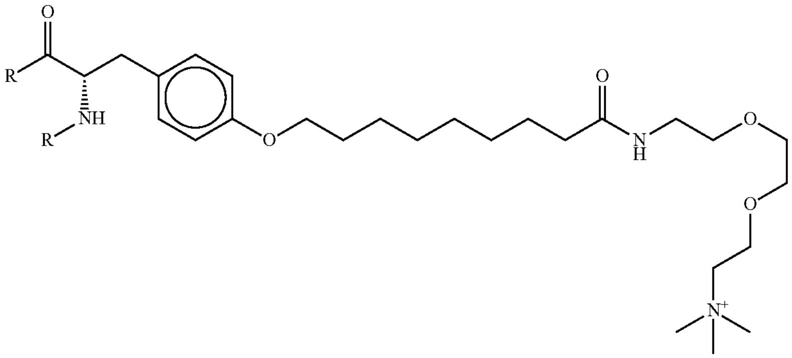<br>C27H46N3O5R2+<br>YC8CO(NHPEG3a) | C[N+](C)(C)CCOCCOCCNC (CCCCCCCCCOc1ccc(C [C@@H](C([R])=O)N[R])cc1)=O | |
| 213 | 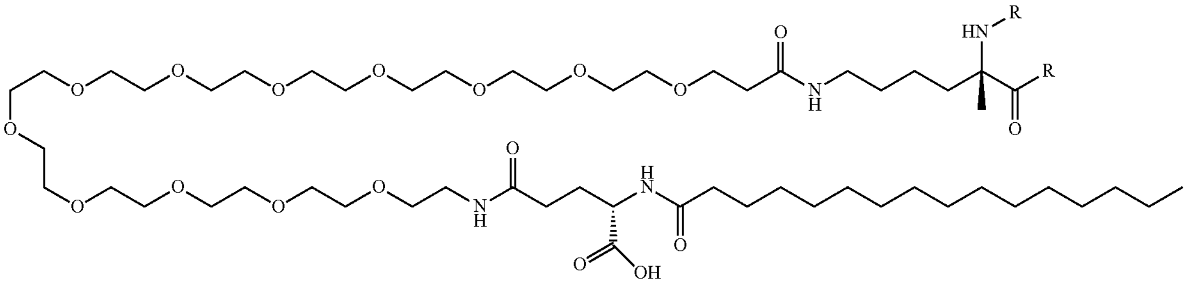<br>C55H104N4O18R2<br>aMeK(PEG12gEC16) | CCCCCCCCCCCCCCCC(N[C@@H] (CCC(NCCOCCOCCOCCOCCOCCO CCOCCOCCOCCOCCOCCOCCC (NCCCC[C@@](C)(C([R])=O)N [R])=O)=O)C(O)=O)=O | |

TABLE 2D-continued
| Peg Moeties and Peg Modified Monomers | | | |
|---|---|---|---|
| 1 | Structure | Names and Synonyms | Smiles Structure |
| 214 | 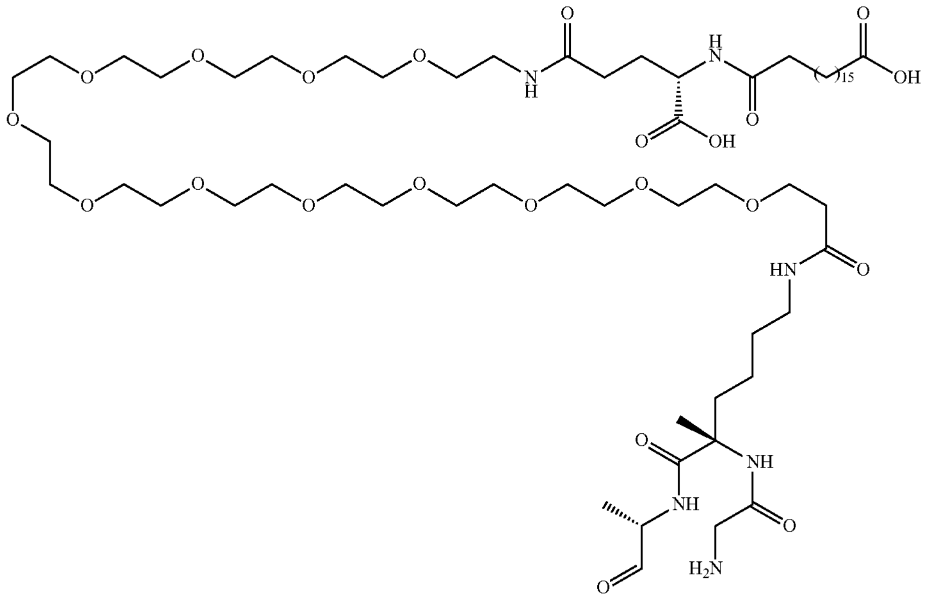<br>C62H116N6O22<br>aMeK(PEG12gEC18OH) | | C[C@@H](C=O)NC([C@](C)(CCCCNC(CCOCCOCCOCCOCCOCCOCCOCCOCCOCCOCCOCCNC(CC[C@@H](C(O)=O)NC(CCCCCCCCCCCCCCCCC(O)=O)=O)=O)=O)NC(CN)=O)=O |

TABLE 2D-continued
| Peg Moeties and Peg Modified Monomers | | | |
|---|---|---|---|
| 1 | Structure | Names and Synonyms | Smiles Structure |
| 215 | 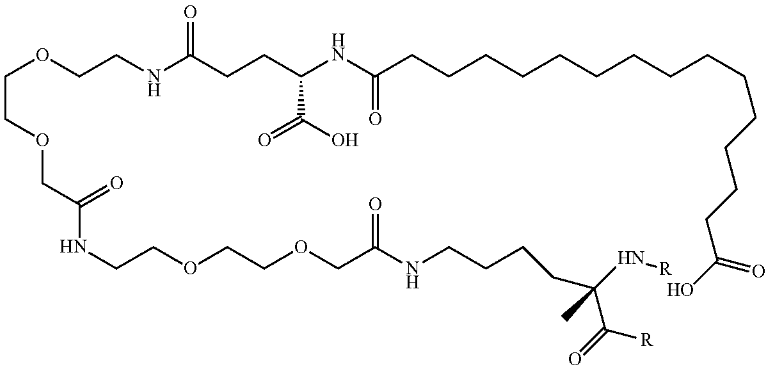<br>C40H71N5O13R2<br>aMeK(PEG2PEG2gEC16OH) | | C[C@](CCCCNC(COCCOCCNC(COCCOCCNC(CC[C@@H](C(O)=O)NC(CCCCCCCCCCCCCCCC(O)=O)=O)=O)=O)=O)=O)(C([R])=O)N[R] |
| 216 | 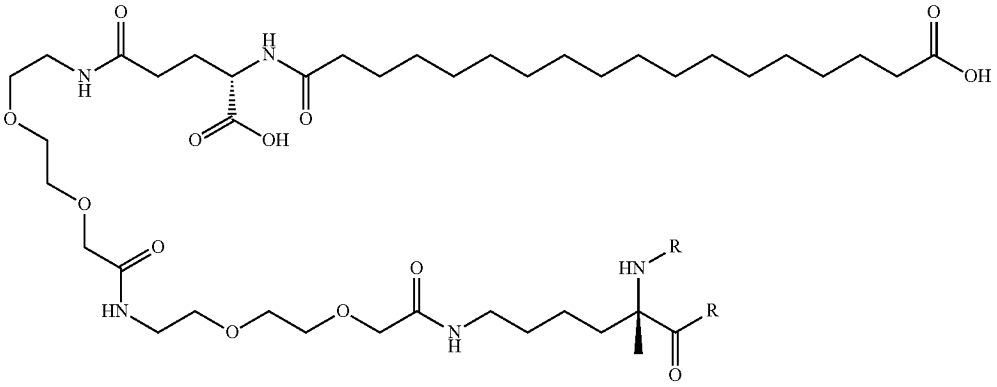<br>C42H75N5O13R2<br>aMeK(PEG2PEG2gEC18OH) | | C[C@](CCCCNC(COCCOCCNC(COCCOCCNC(CC[C@@H](C(O)=O)NC(CCCCCCCCCCCCCCCCCC(O)=O)=O)=O)=O)=O)(C([R])=O)N[R] |

TABLE 2D-continued
| Peg Moeties and Peg Modified Monomers | | | |
|---|---|---|---|
| 1 | Structure | Names and Synonyms | Smiles Structure |
| 217 | 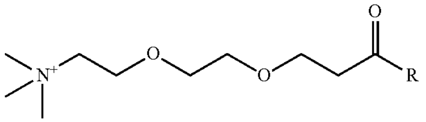 C10H21NO3R+ cPEG3aCO, cPEG3a | | C[N+](C)(C)CCOCCOCCC([R])=O |
| 218 | 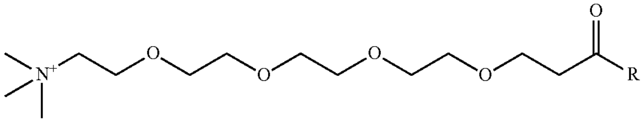 C14H29NO5R+ cPEG5aCO, cPEG5a | | C[N+](C)(C)CCOCCOCCOCCOCCC ([R])=O |
| 219 | 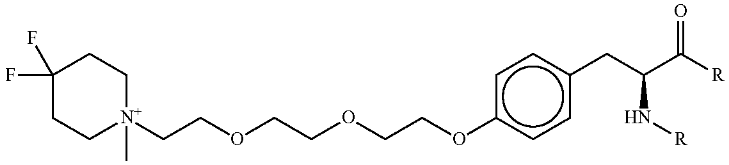 C21H31F2N2O4R2+ dFPPEG3F | | C[N+](CCOCCOCCOc1ccc(C[C@@H] (C([R])=O)N[R])cc1)(CC1)CCC1(F)F |
| 220 | 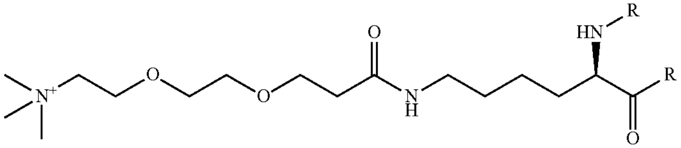 C16H32N3O4R2+ dK(cPEG3a), k(cPEG3a), dK(cPEG3aCO), k(cPEG3aCO) | | C[N+](C)(C)CCOCCOCCC(NCCCC [C@H](C([R])=O)N[R])=O |

TABLE 2D-continued

Peg Moeties and Peg Modified Monomers

| 1 | Structure | Names and Synonyms | Smiles Structure |
| --- | --- | --- | --- |
| 221 | 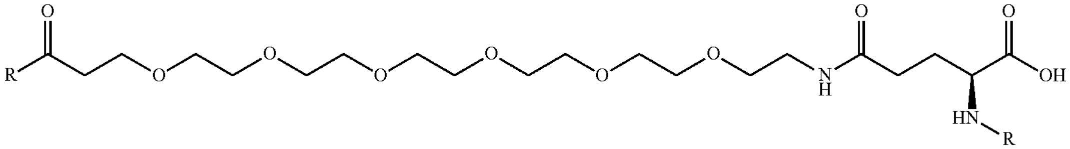<br>C20H36N2O10R2<br>gEPEG6 | | OC([C@H](CCC(NCCOCCOCCOCCOCCOCCOCCC([R])=O)=O)N[R])=O |
| 222 | 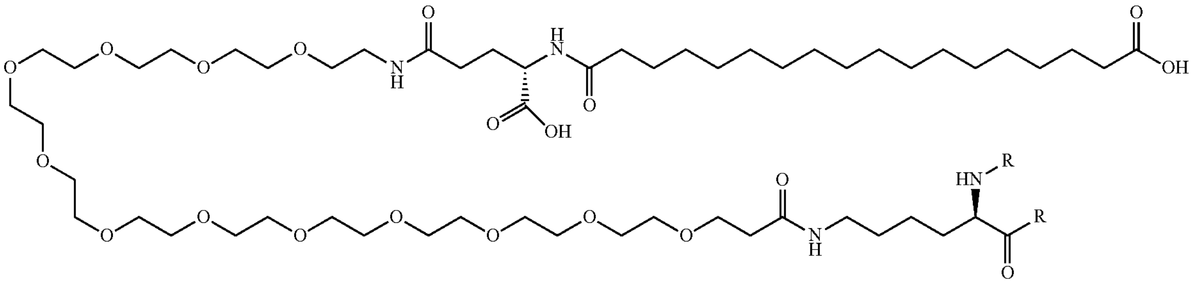<br>C56H104N4O20R2<br>k(PEG12gEC18OH), dK(PEG12gEC18OH) | | OC(CCCCCCCCCCCCCCCCC(N[C@@H](CCC(NCCOCCOCCOCCOCCOCCOCCOCCOCCOCCOCCOCCOCCC(NCCCC[C@H](C([R])=O)N[R])=O)=O)C(O)=O)=O)=O |
| 223 | 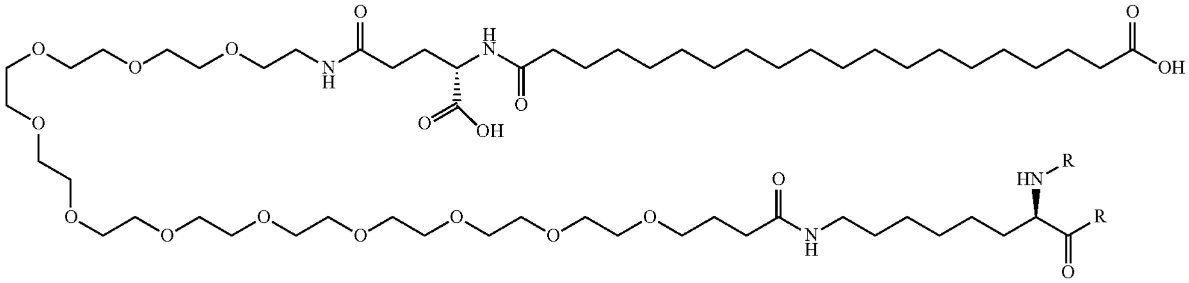<br>C58H108N4O20R2<br>k(PEG12gEC20OH)<br>dK(PEG12gEC20OH) | | OC(CCCCCCCCCCCCCCCCCCC(N[C@@H](CCC(NCCOCCOCCOCCOCCOCCOCCOCCOCCOCCOCCOCCOCCCC(NCCCC[C@H](C([R])=O)N[R])=O)=O)C(O)=O)=O)=O |

TABLE 2D-continued

Peg Moeties and Peg Modified Monomers

| 1 | Structure | Names and Synonyms | Smiles Structure |
| --- | --- | --- | --- |
| 224 | 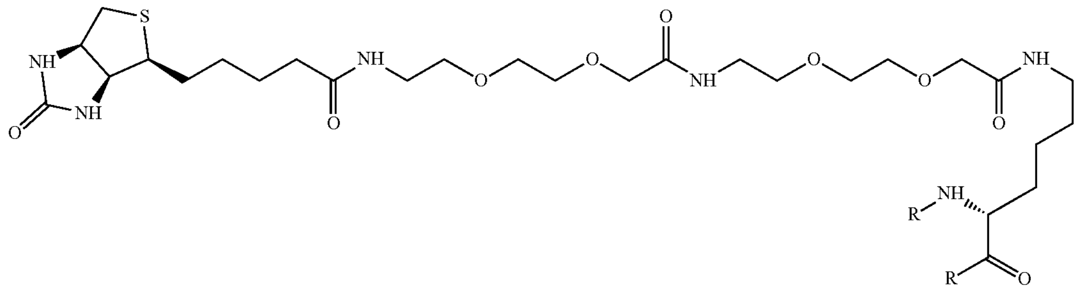 | C28H48N6O9SR2 dK(PEG2PEG2Biotin), k(PEG2PEG2Biotin) | O=C(CCCC[C@@H]([C@H]1N2)SC [C@@H]1NC2=O)NCCOCCOCC (NCCOCCOCC(NCCCC [C@H](C([R])=O)N([R])=O)=O |
| 225 | 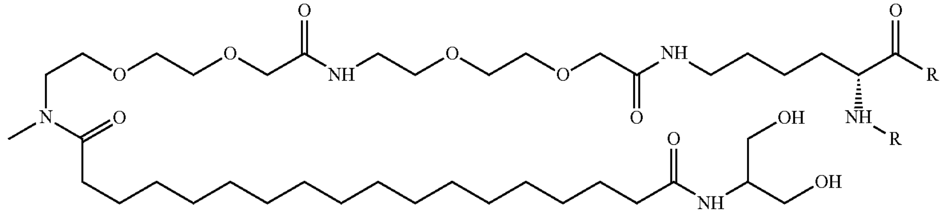 | C40H75N5O11R2 k(PEG2PEG2C18GolB), dK(PEG2PEG2C18GolB) | CN(CCOCCOCC(NCCOCCOCC (NCCCC[C@H](C([R])=O)N [R])=O)=O)C (CCCCCCCCCCCCCCCCC (NC(CO)CO)=O)=O |
| 226 | 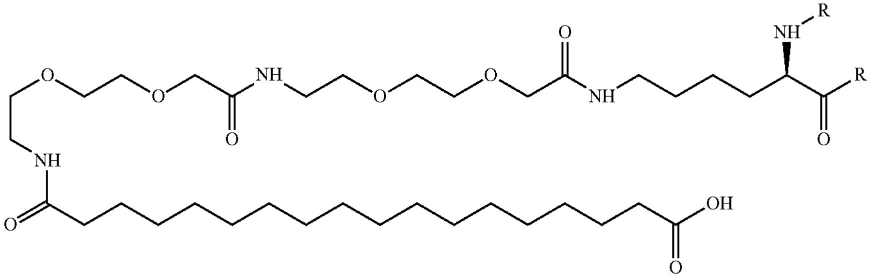 | | OC(CCCCCCCCCCCCCCCCC (NCCOCCOCC(NCCOCCOCC (NCCCC[C@H](C([R])=O)N [R])=O)=O)=O)=O |

TABLE 2D-continued
| Peg Moeties and Peg Modified Monomers | | | |
|---|---|---|---|
| 1 | Structure | Names and Synonyms | Smiles Structure |
| 227 | C36H66N4O10R2<br>k(PEG2PEG2C18OH),<br>dK(PEG2PEG2C18OH)<br>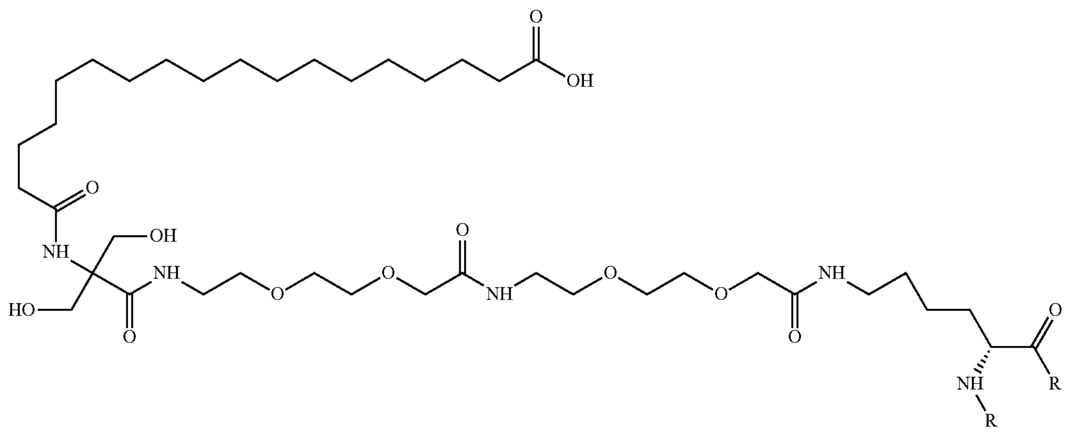<br>C40H73N5O13R2<br>k(PEG2PEG2GolAC18OH),<br>dK(PEG2PEG2GolAC18OH) | | OCC(CO)(C(NCCOCCOCC(NCCOCCOCC(NCCCC[C@H](C([R])=O)N[R])=O)=O)=O)NC(CCCCCCCCCCCCCCCCC(O)=O)=O |

TABLE 2D-continued

| Peg Moeties and Peg Modified Monomers | | | |
|---|---|---|---|
| 1 | Structure | Names and Synonyms | Smiles Structure |
| 228 | 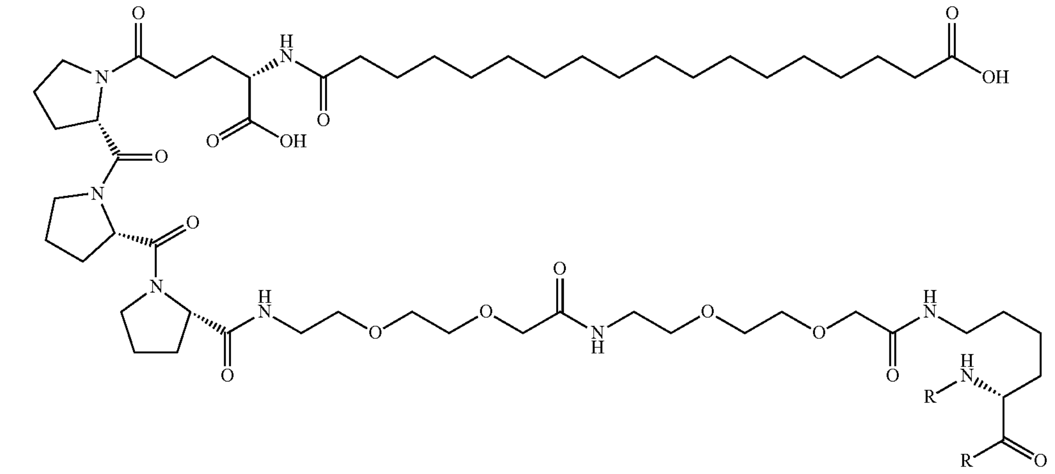<br>C56H94N8O16R2<br>k(PEG2PEG2PPPgEC18OH)<br>dK(PEG2PEG2PPPgEC18OH) | | OC(CCCCCCCCCCCCCCCCCC(N[C@@H](CCC(N(CCC1)[C@@H]1C(N(CCC1)[C@@H]1C(N(CCC1)[C@@H]1C(NCCOCCOCC(NCCOCCOCC(NCCCC[C@H](C([R])=O)N[R])=O)=O)=O)=O)=O)=O)C(O)=O)=O)=O |
| 229 | 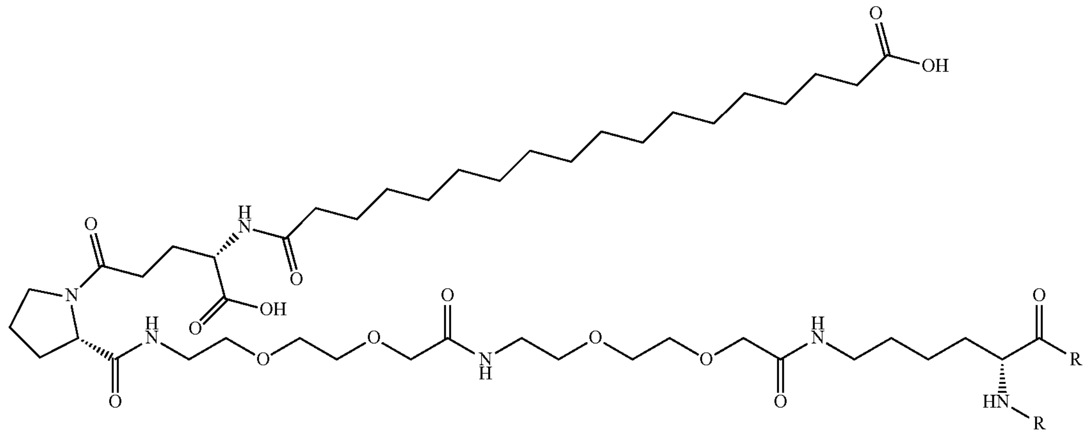 | | OC(CCCCCCCCCCCCCCCCCC(N[C@@H](CCC(N(CCC1)[C@@H]1C(NCCOCCOCC(NCCOCCOCC(NCCCC[C@H](C([R])=O)N[R])=O)=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| | | C46H80N6O14R2 k(PEG2PEG2PgEC18OH), dK(PEG2PEG2PgEC18OH) | |
| 230 | 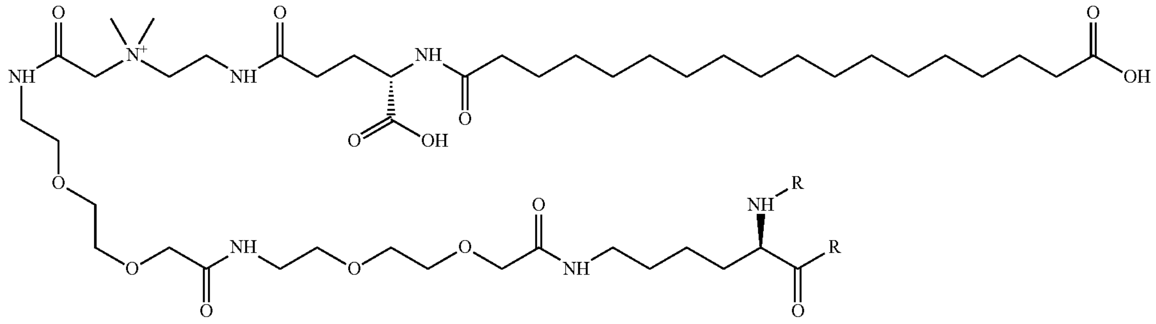 | C47H86N7O14R2+ k(PEG2PEG2Sp6gEC18OH), dK(PEG2PEG2Sp6gEC18OH) | C[N+](C)(CCNC(CC[C@@H](C(O)=O)NC(CCCCCCCCCCCCCCCCC(O)=O)=O)=O)CC(NCCOCCOCC(NCCOCCOCC(NCCCC[C@H](C(\[R\])=O)N[R])=O)=O)=O |
| 231 | 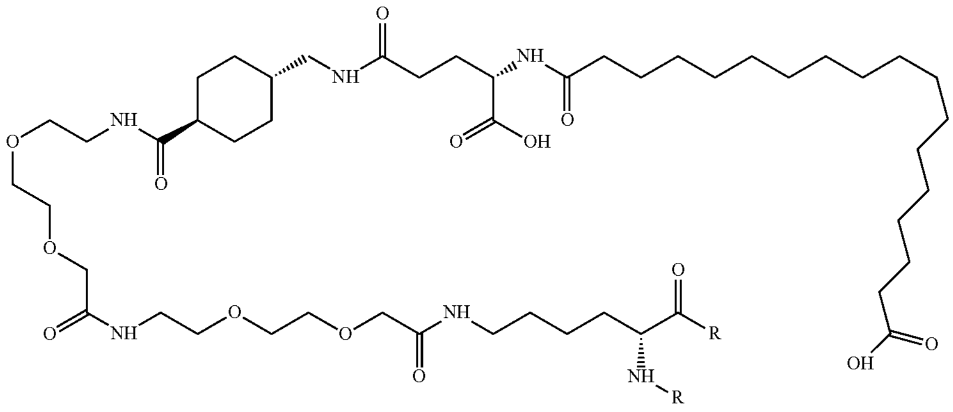 | C49H86N6O14R2 k(PEG2PEG2TrxgEC18OH), dK(PEG2PEG2TrxgEC18OH) | OC(CCCCCCCCCCCCCCCCC(N[C@@H](CCC(NC[C@H](CC1)CC[C@@H]1C(NCCOCCOCC(NCCOCCOCC(NCCCC[C@H](C([R])=O)N[R])=O)=O)=O)=O)C(O)=O)=O)=O |

TABLE 2D-continued
| Peg Moeties and Peg Modified Monomers | | | |
|---|---|---|---|
| 1 | Structure | Names and Synonyms | Smiles Structure |
| 232 | 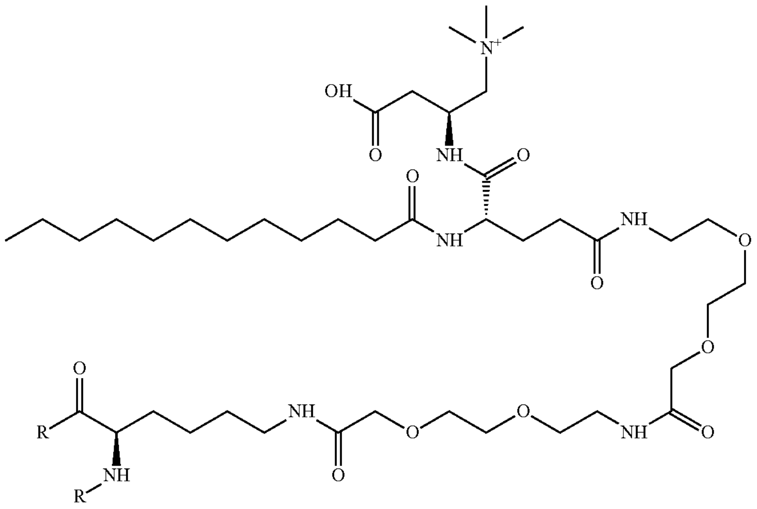<br>C42H78N7012R2+<br>k(PEG2PEG2gE(C)C12,<br>dK(PEG2PEG2gE(C)C12 | | CCCCCCCCCCCC(N[C@@H](CCC(NCCOCCOCC(NCCOCCOCC(NCCCC[C@H](C([R])=O)N[R])=O)=O)=O)C(N[C@@H](CC(O)=O)C[N+](C)(C)C)=O)=O |

TABLE 2D-continued
Peg Moeties and Peg Modified Monomers
| 1 | Structure | Names and Synonyms | Smiles Structure |
|---|---|---|---|
| 233 | 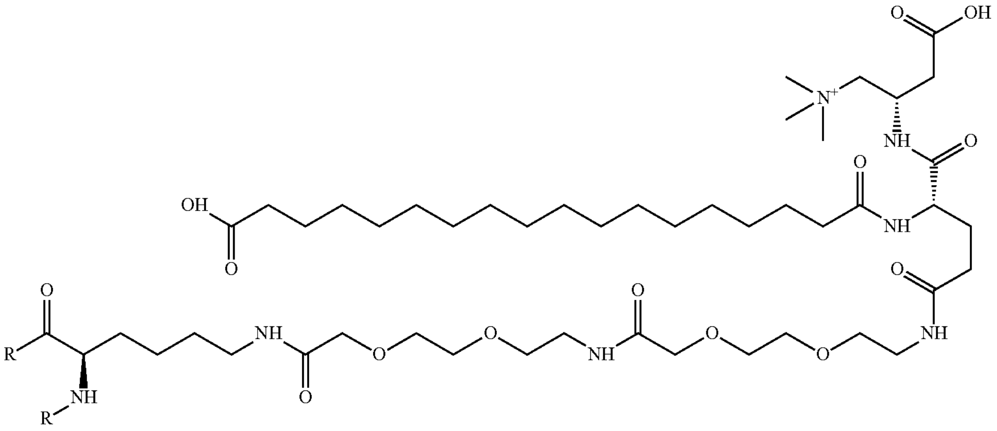 | C48H88N7O14R2+ k(PEG2PEG2gE(C)C18OH, dK(PEG2PEG2gE(C)C18OH | C[N+](C)(C)C[C@H](CC(O)=O)NC([C@H](CCC(NCCOCCOCC(NCCOCCOCC(NCCCC[C@H](C([R])=O)N[R])=O)=O)=O)NC(CCCCCCCCCCCCCCCCC(O)=O)=O)=O |
| 234 | 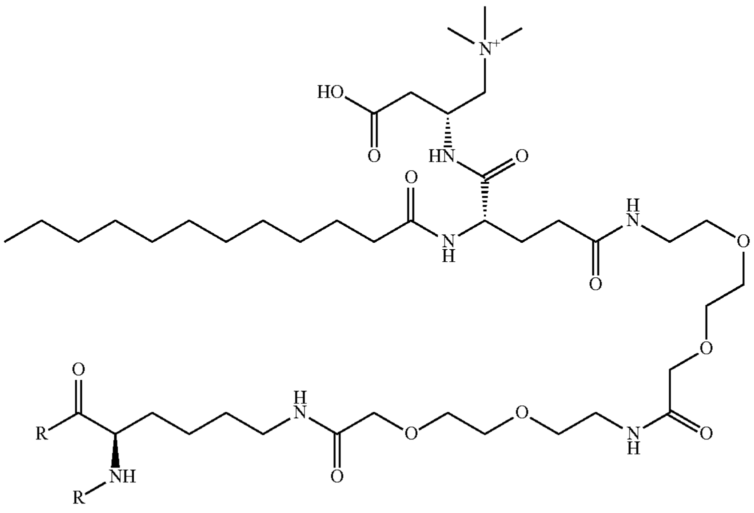 | | CCCCCCCCCCCC(N[C@@H](CCC(NCCOCCOCC(NCCOCCOCC(NCCCC[C@H](C([R])=O)N[R])=O)=O)=O)C(N[C@H](CC(O)=O)C[N+](C)(C)C)=O)=O |

TABLE 2D-continued

| Peg Moeties and Peg Modified Monomers | | | |
|---|---|---|---|
| 1 | Structure | Names and Synonyms | Smiles Structure |
| 235 | C42H78N7O12R2+<br>k(PEG2PEG2gE(c)C12,<br>dK(PEG2PEG2gE(c)C12<br>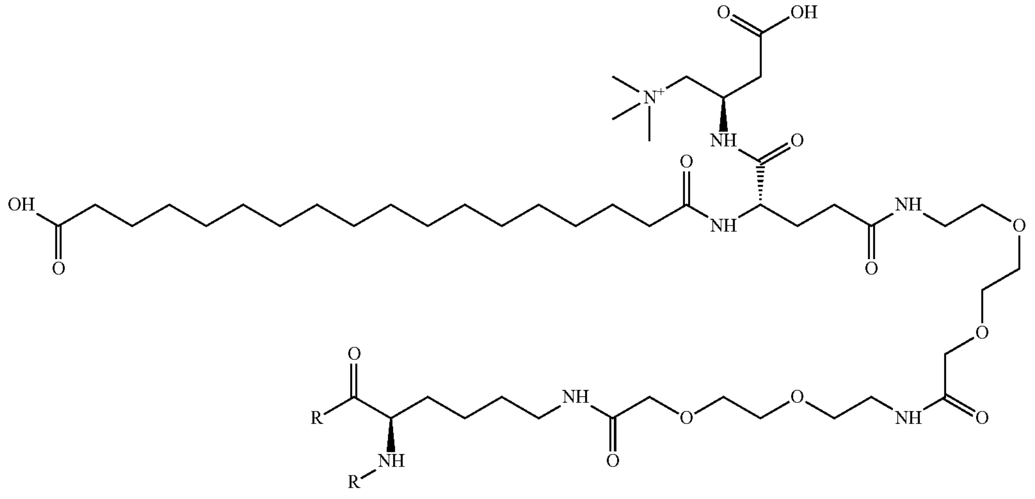 | | C[N+](C)(C)C[C@@H](CC(O)=O)NC([C@H](CCC(NCCOCCOCC(NCCOCCOCC(NCCCC[C@H](C([R])=O)N[R])=O)=O)=O)NC(CCCCCCCCCCCCCCCCC(O)=O)=O)=O |
| 236 | C48H88N7O14R2+<br>k(PEG2PEG2gE(c)C18OH,<br>dK(PEG2PEG2gE(c)C18OH<br>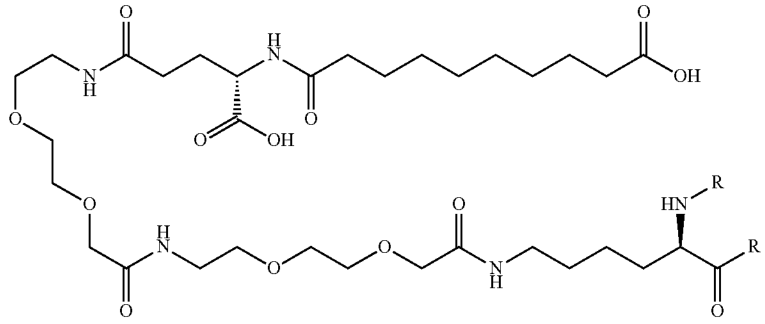 | | OC(CCCCCCCCC(N[C@@H](CCC(NCCOCCOCC(NCCOCCOCC(NCCCC[C@H](C([R])=O)N[R])=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| | C33H57N5O13R2<br>k(PEG2PEG2gEC10OH),<br>dK(PEG2PEG2gEC10OH) | | |
| 237 | 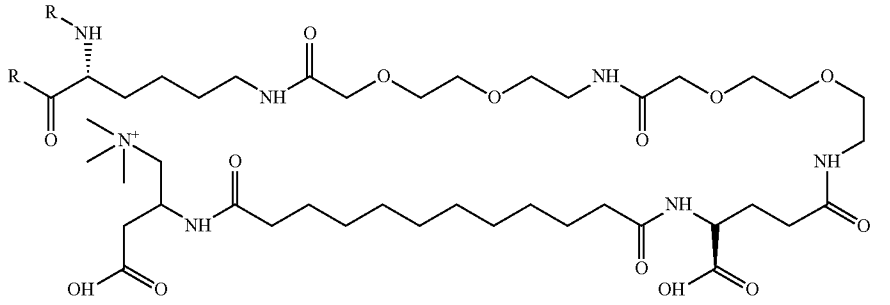<br>C42H76N7O14R2+<br>k(PEG2PEG2gEC12OH(C),<br>dK(PEG2PEG2gEC12OH(C) | | C[N+](C)(C)C[C@H](CC(O)=O)NC(CCCCCCCCCCCC(N[C@@H](CCC(NCCOCCOCC(NCCOCCOCC(NCCCC[C@H](C([R])=O)N[R])=O)=O)=O)C(O)=O)=O)=O |
| 238 | 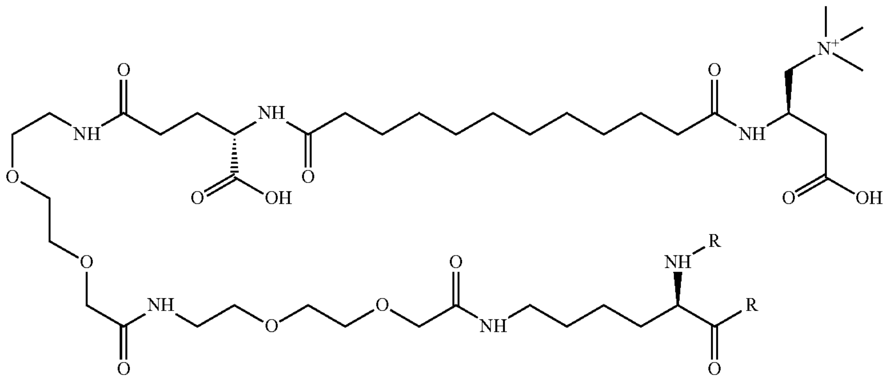<br>C42H76N7O14R2+<br>k(PEG2PEG2gEC12OH(c),<br>dK(PEG2PEG2gEC12OH(c) | | C[N+](C)(C)C[C@@H](CC(O)=O)NC(CCCCCCCCCCCC(N[C@@H](CCC(NCCOCCOCC(NCCOCCOCC(NCCCC[C@H](C([R])=O)N[R])=O)=O)=O)C(O)=O)=O)=O |

TABLE 2D-continued
Peg Moeties and Peg Modified Monomers
| 1 | Structure | Names and Synonyms | Smiles Structure |
|---|---|---|---|
| 239 | 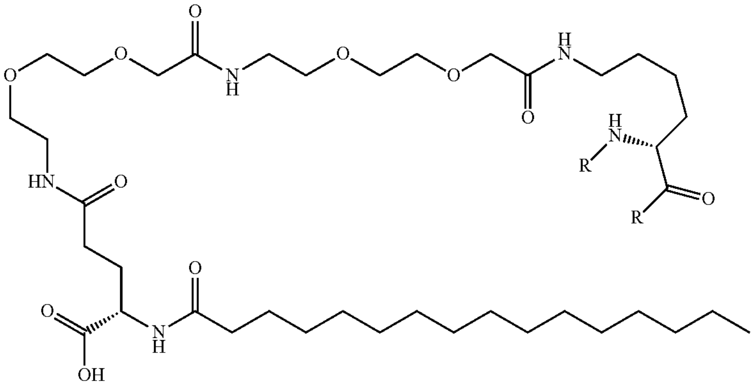 C39H71N5O11R2 k(PEG2PEG2gEC16), dK(PEG2PEG2gEC16) | | CCCCCCCCCCCCCCCC(N[C@@H](CCC(NCCOCCOCC(NCCOCCOCC(NCCCC[C@H](C([R])=O)N[R])=O)=O)=O)C(O)=O)=O |
| 240 | 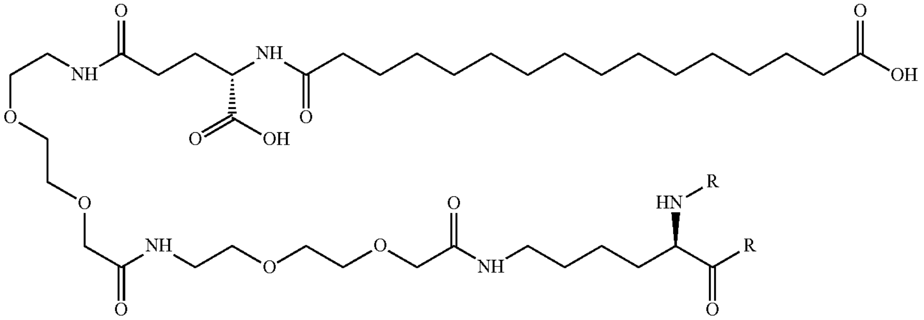 C39H69N5O13R2 k(PEG2PEG2gEC16OH), dK(PEG2PEG2gEC16OH) | | OC(CCCCCCCCCCCCCCC(N[C@@H](CCC(NCCOCCOCC(NCCOCCOCC(NCCCC[C@H](C([R])=O)N[R])=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 241 | 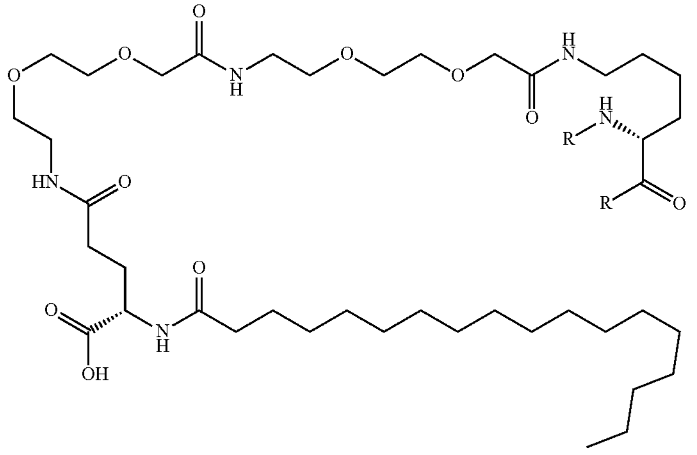<br>C41H75N5O11R2<br>k(PEG2PEG2gEC18),<br>dK(PEG2PEG2gEC18) | | CCCCCCCCCCCCCCCCCC(N[C@@H](CCC(NCCOCCOCC(NCCOCCOCC(NCCCC[C@H](C([R])=O)N[R])=O)=O)=O)C(O)=O)=O |
| 242 | 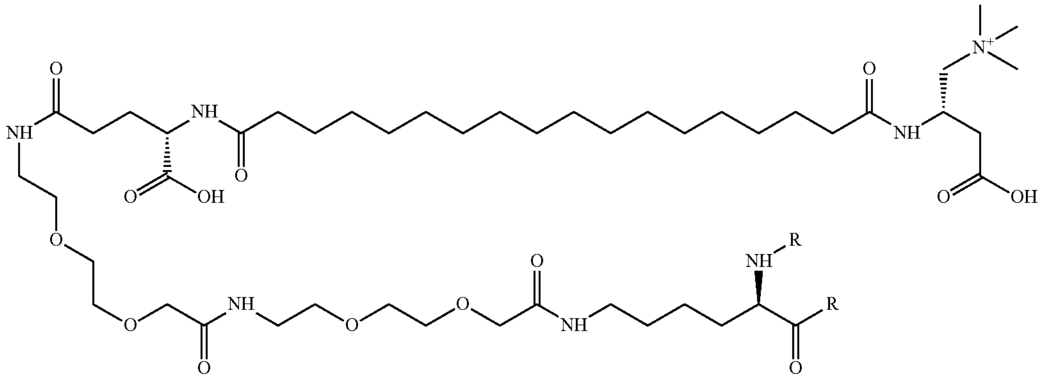<br>C48H88N7O14R2+<br>k(PEG2PEG2gEC18OH(C),<br>dK(PEG2PEG2gEC18OH(C) | | C[N+](C)(C)C[C@H](CC(O)=O)NC(CCCCCCCCCCCCCCCCC(N[C@@H](CCC(NCCOCCOCC(NCCOCCOCC(NCCCC[C@H](C([R])=O)N[R])=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 243 | 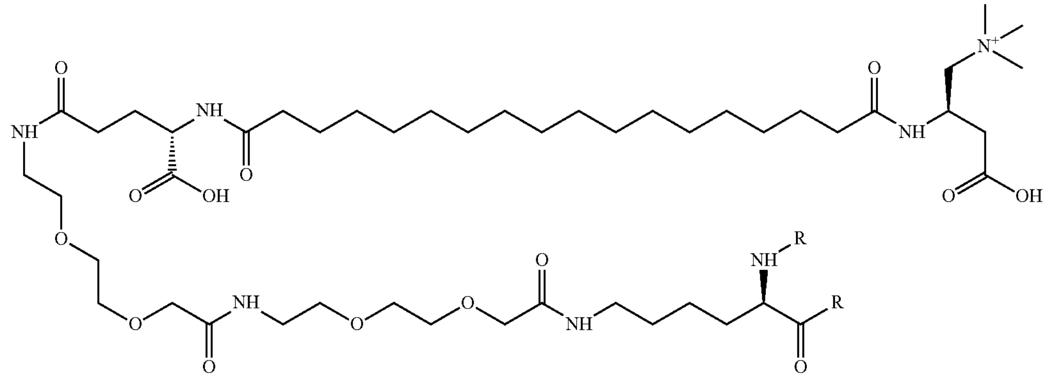<br>C48H88N7O14R2+<br>k(PEG2PEG2gEC18OH(c),<br>dK(PEG2PEG2gEC18OH(c) | | C[N+](C)(C)C[C@@H](CC(O)=O)NC(CCCCCCCCCCCCCCCCC(N[C@@H](CCC(NCCOCCOCC(NCCOCCOCC(NCCCC[C@H](C([R])=O)N[R])=O)=O)=O)C(O)=O)=O)=O |
| 244 | 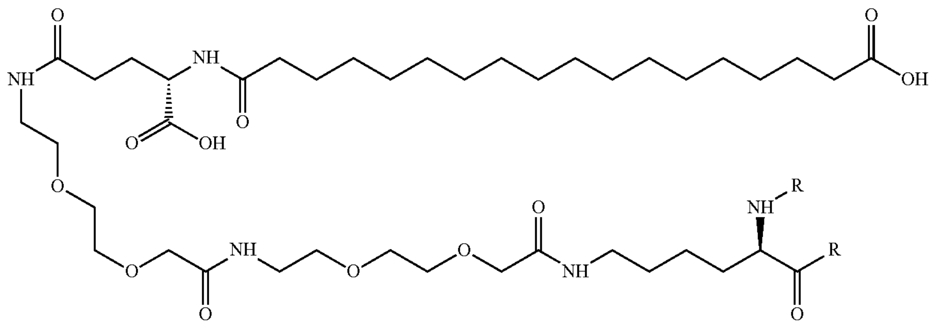<br>C41H73N5O13R2<br>k(PEG2PEG2gEC18OH),<br>dK(PEG2PEG2gEC18OH) | | OC(CCCCCCCCCCCCCCCCC(N[C@@H](CCC(NCCOCCOCC(NCCOCCOCC(NCCCC[C@H](C([R])=O)N[R])=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 245 | 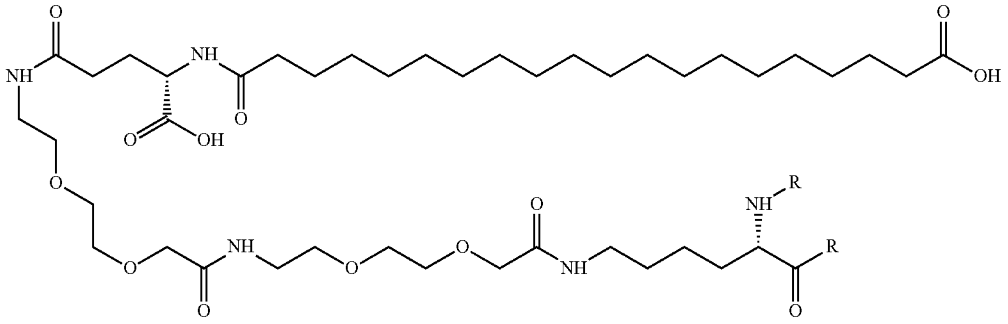 C43H77N5O13R2 k(PEG2PEG2gEC20OH), dK(PEG2PEG2gEC20OH) | | OC(CCCCCCCCCCCCCCCCCCC(N[C@@H](CCC(NCCOCCOCC(NCCOCCOCC(NCCCC[C@H](C([R])=O)N[R])=O)=O)=O)C(O)=O)=O)=O |
| 246 | 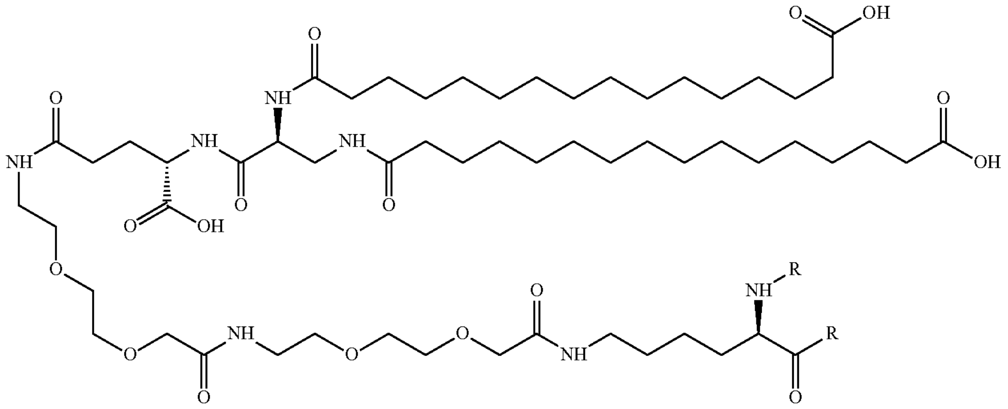 C58H103N7O17R2 k(PEG2PEG2gEDAP(C16OH)2), dK(PEG2PEG2gEDAP(C16OH)2) | | OC(CCCCCCCCCCCCCCC(NC[C@@H](C(N[C@@H](CCC(NCCOCCOCC(NCCOCCOCC(NCCCC[C@H](C([R])=O)N[R])=O)=O)=O)C(O)=O)=O)NC(CCCCCCCCCCCCCCC(O)=O)=O)=O)=O |

TABLE 2D-continued

Peg Moeties and Peg Modified Monomers

| 1 | Structure | Names and Synonyms | Smiles Structure |
|---|---|---|---|
| 247 | 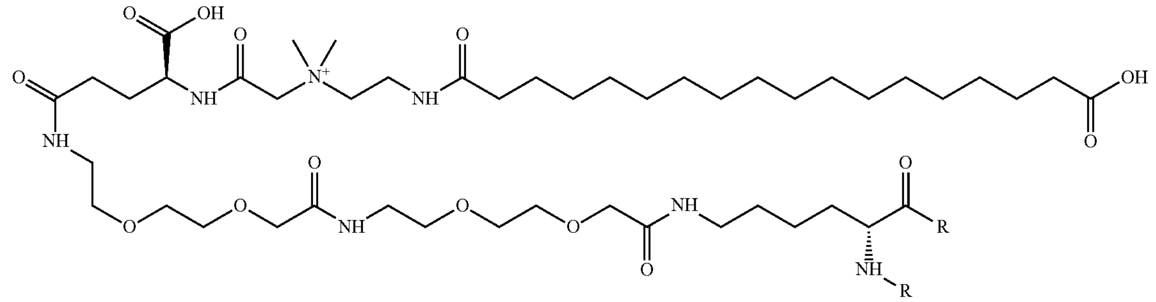<br>C47H86N7O14R2+<br>kPEG2PEG2gEDAP(C16OH)2; kPEG2PEG2<br>gEDap(C16OH)2,<br>k(PEG2PEG2gEDAP(C16OH)2),<br>dKPEG2PEG2gEDAP(C16OH)2; dKPEG2PE<br>G2gEDap(C16OH)2,<br>dK(PEG2PEG2gEDAP(C16OH)2) | | C[N+](C)(CCNC(CCCCCCCCCCC<br>CCCCCC(O)=O)=O)CC(N[C@@H]<br>(CCC(NCCOCCOCC(NCCOCCOCC<br>(NCCCC[C@H](C([R])=O)N[R])=<br>O)=O)=O)C(O)=O)=O |
| 248 | 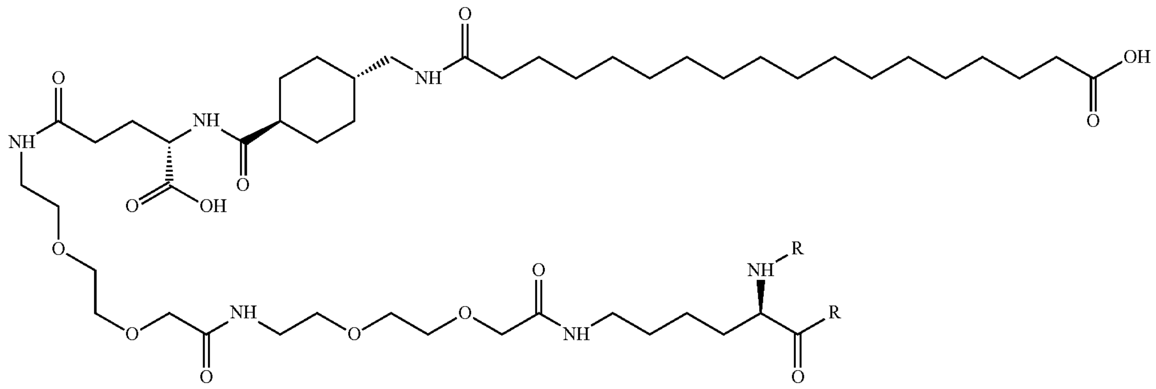<br>C49H86N6O14R2<br>kPEG2PEG2gEDAP(C16OH)2,<br>dKPEG2PEG2gEDAP(C16OH)2 | | OC(CCCCCCCCCCCCCCCCC(NC<br>[C@H](CC1)CC[C@@H]1C<br>(N[C@@H](CCC(NCCOCCOCC<br>(NCCOCCOCC(NCCCC<br>[C@H](C([R])=O)N[R])=<br>O)=O)=O)C(O)=O)=O)=O)=O |

TABLE 2D-continued

| Peg Moeties and Peg Modified Monomers | | | |
|---|---|---|---|
| 1 | Structure | Names and Synonyms | Smiles Structure |
| 249 | 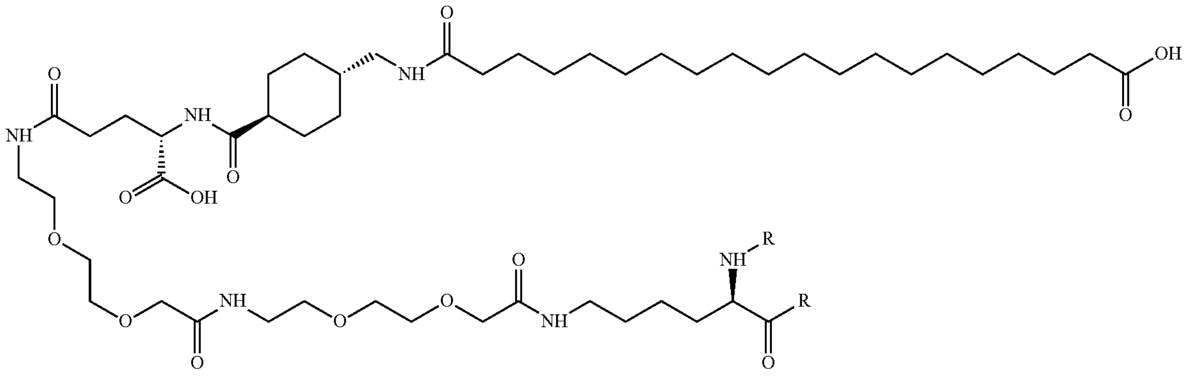<br>c<br>C51H90N6O14R2<br>k(PEG2PEG2gESp6C18OH),<br>dK(PEG2PEG2gESp6C18OH) | OC(CCCCCCCCCCCCCCCCCCC(NC[C@H](CC1)CC[C@@H]1C(N[C@@H](CCC(NCCOCCOCC(NCCOCCOCC(NCCCC[C@H](C([R])=O)N[R])=O)=O)=O)C(O)=O)=O)=O)=O | |
| 250 | 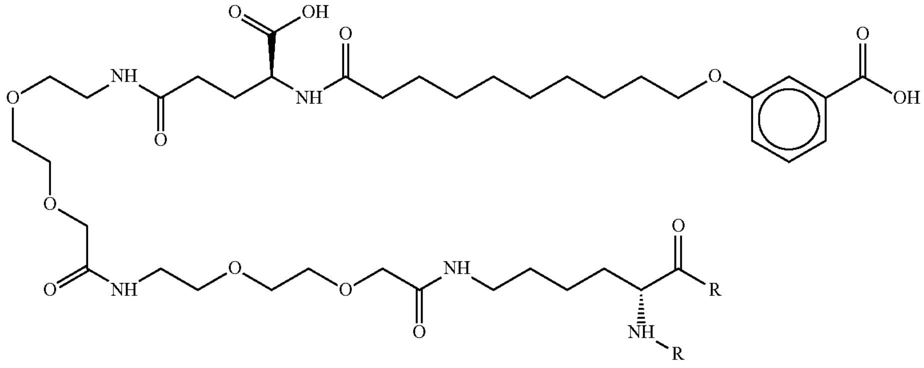<br>C40H63N5O14R2<br>k(PEG2PEG2gETrxC18OH),<br>dK(PEG2PEG2gETrxC18OH) | OC([C@H](CCC(NCCOCCOCC(NCCOCCOCC(NCCCC[C@H](C([R])=O)N[R])=O)=O)NC(CCCCCCCCCOc1cc(C(O)=O)ccc1)=O)=O | |

TABLE 2D-continued

| Peg Moeties and Peg Modified Monomers | | | |
|---|---|---|---|
| 1 | Structure | Names and Synonyms | Smiles Structure |
| 251 | 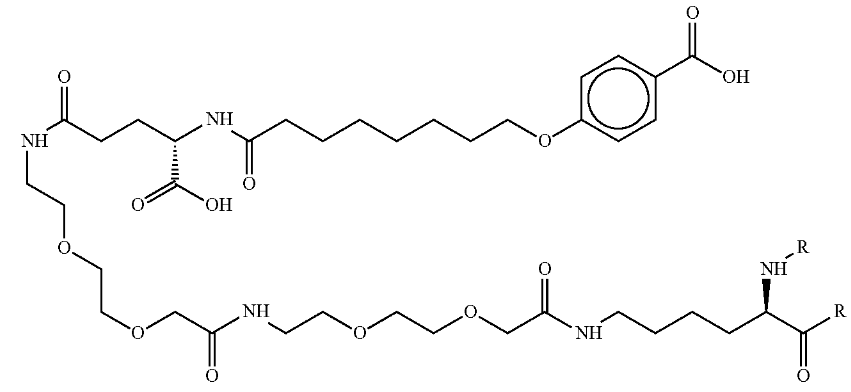 | C40H63N5O14R2 k(PEG2PEG2gETrxC20OH), dK(PEG2PEG2gETrxC20OH) | OC([C@H](CCC(NCCOCCOCC(NCCOCCOCC(NCCCC[C@H](C([R])=O)N[R])=O)=O)=O)NC(CCCCCCCCCOc(cc1)ccc1C(O)=O)=O)=O |
| 252 | 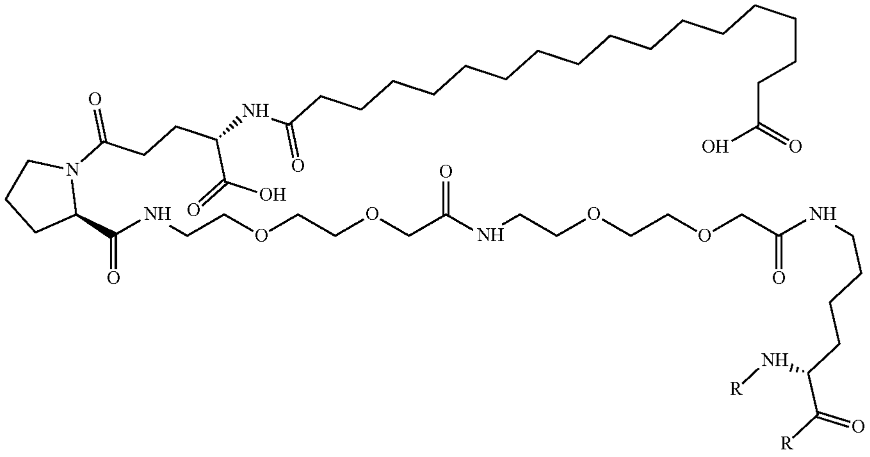 | C46H80N6O14R2 k(PEG2PEG2gEmXOH), dK(PEG2PEG2gEmXOH) | OC(CCCCCCCCCCCCCCCCC(N[C@@H](CCC(N(CCC1)[C@H]1C(NCCOCCOCC(NCCOCCOCC(NCCCC[C@H](C([R])=O)N[R])=O)=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 253 | 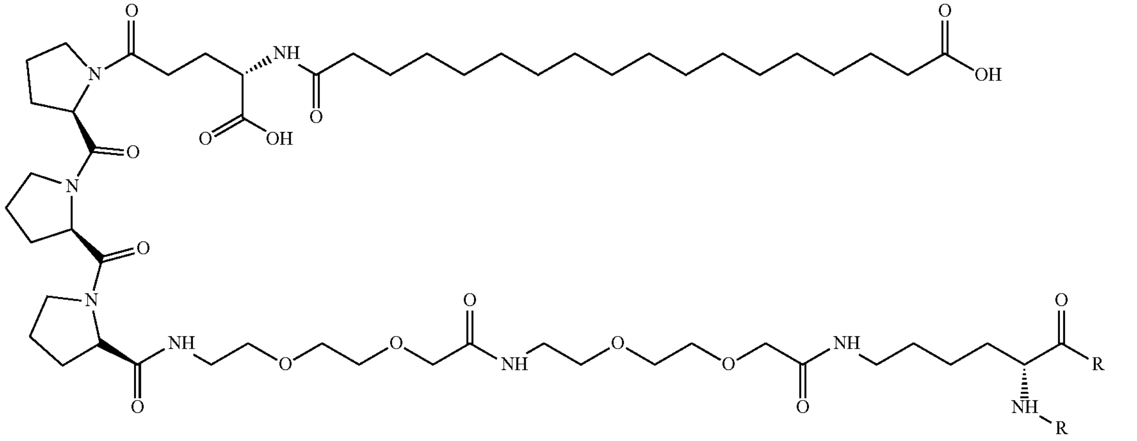 | C56H94N8O16R2 k(PEG2PEG2gEpXOH), dK(PEG2PEG2gEpXOH) | OC(CCCCCCCCCCCCCCCCC(N[C@@H](CCC(N(CCC1)[C@H]1C(N(CCC1)[C@H]1C(N(CCC1)[C@H]1C(NCCOCCOCC(NCCOCCOCC(NCCCC[C@H](C([R])=O)N[R])=O)=O)=O)=O)=O)=O)C(O)=O)=O)=O |
| 254 | 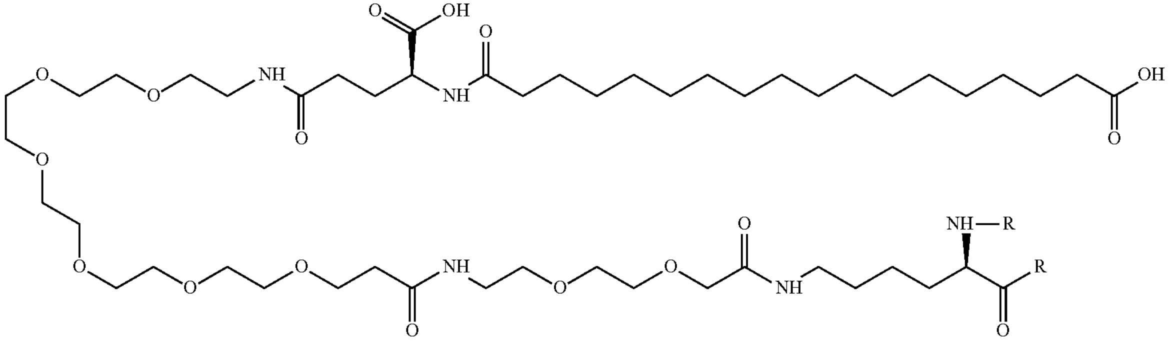 | C50H91N5O17R2 k(PEG2PEG2pgEC18OH), dK(PEG2PEG2pgEC18OH) | OC(CCCCCCCCCCCCCCCCC(N[C@@H](CCC(NCCOCCOCCOCCOCCOCCOCCC(NCCOCCOCC(NCCCC[C@H](C([R])=O)N[R])=O)=O)=O)C(O)=O)=O)=O |

TABLE 2D-continued

| Peg Moeties and Peg Modified Monomers | | | |
|---|---|---|---|
| 1 | Structure | Names and Synonyms | Smiles Structure |
| 255 | 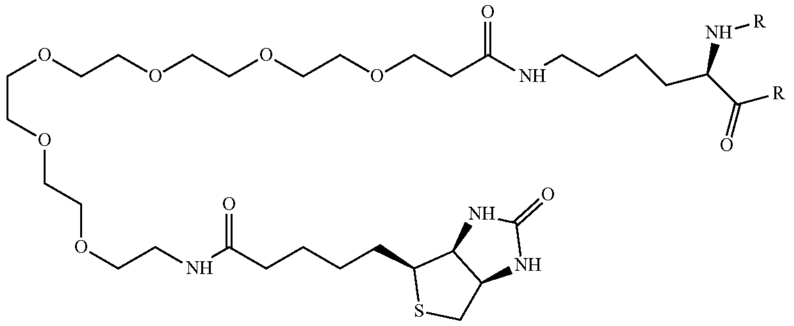 C31H55N5O10SR2 k(PEG2PEG2pppgEC18OH), dK(PEG2PEG2pppgEC18OH) | | O=C(CCCC[C@@H]([C@H]1N2)SC[C@@H]1NC2=O)NCCOCCOCCOCCOCCOCCOCCOCCC(NCCCC[C@H](C([R])=O)N[R])=O |
| 256 | 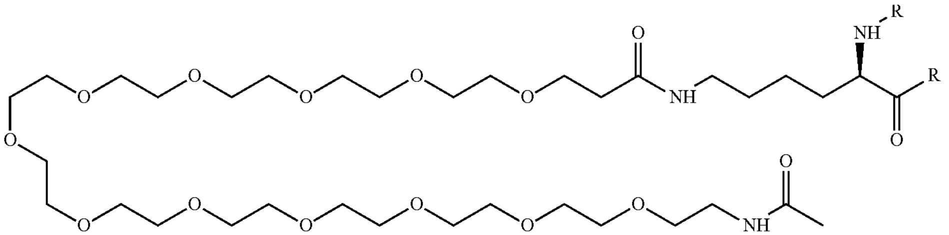 C35H67N3L15R2 k(PEG2PEG6gEC18OH), dK(PEG2PEG6gEC18OH) | | CC(NCCOCCOCCOCCOCCOCCOCCOCCOCCOCCOCCOCCOCCC(NCCCC[C@H](C([R])=O)N[R])=O)=O |
| 257 | 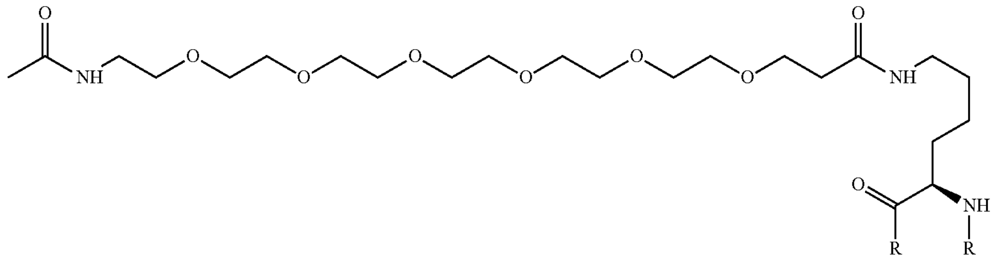 | | CC(NCCOCCOCCOCCOCCOCCOCCC(NCCCC[C@H](C([R])=O)N[R])=O)=O |

TABLE 2D-continued
| Peg Moeties and Peg Modified Monomers | | | |
|---|---|---|---|
| 1 | Structure | Names and Synonyms | Smiles Structure |
| | C23H43N3O9R2<br>k(dPEG12AcBr), dK(dPEG12AcBr) | | |
| 258 | 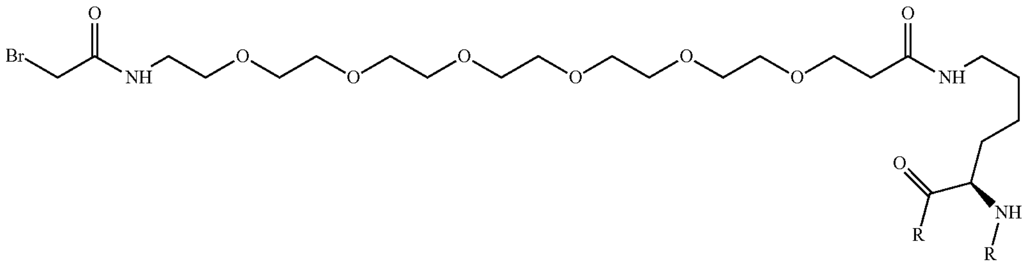<br>C23H42BrN3O9R2<br>k(dPEG12AcVitE), dK(dPEG12AcVitE) | | O=C(CCOCCOCCOCCOCCOCCO CCNC(CBr)=O)NCCCC[C@H](C ([R])=O)N[R] |
| 259 | 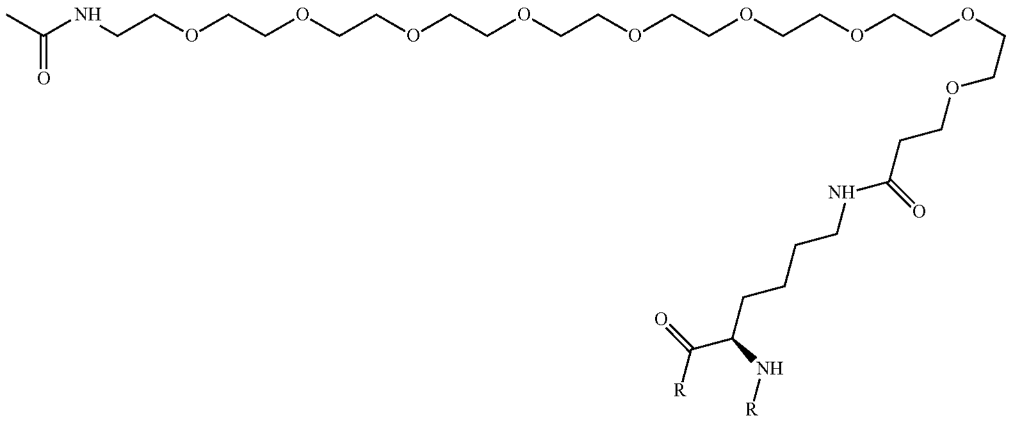<br>C29H55N3O12R2<br>k(dPEG6Ac), dK(dPEG6Ac) | | CC(NCCOCCOCCOCCOCCOCCOC COCCOCCOCCC(NCCCC[C@H](C ([R])=O)N[R])=O)=O |

TABLE 2D-continued

Peg Moeties and Peg Modified Monomers

| 1 | Structure | Names and Synonyms | Smiles Structure |
|---|---|---|---|
| 260 | 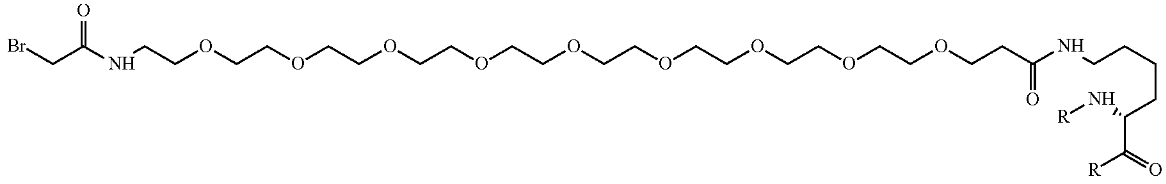<br>C29H54BrN3O12R2<br>k(dPEG6AcBr), dK(dPEG6AcBr) | | O=C(CCOCCOCCOCCOCCOCCOC COCCOCCOCCNC(CBr)=O)NCCCC [C@H](C([R])=O)N[R] |
| 261 | 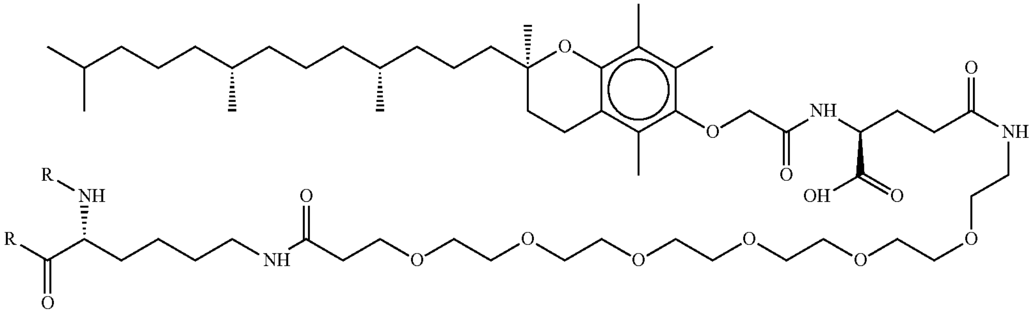<br>C57H98N4O14R2<br>k(dPEG9Ac), dK(dPEG9Ac) | | CC(C)CCC[C@@H](C)CCC[C@@H] (C)CCC[C@](C)(CC1)Oc(c(C)c2C)c1c (C)c2OCC(N[C@@H](CCC(NCCOCC OCCOCCOCCOCCOCCC(NCCCC [C@H](C([R])=O)N[R])=O)=O)C(O)= O)=O |
| 262 | 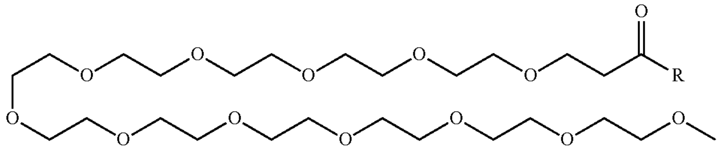<br>C26H51O13R<br>mPEG12CO | | COCCOCCOCCOCCOCCOCCOCC OCCOCCOCCOCCOCCC([R])=O |

TABLE 2D-continued
| Peg Moeties and Peg Modified Monomers | | | |
|---|---|---|---|
| 1 | Structure | Names and Synonyms | Smiles Structure |
| 263 | 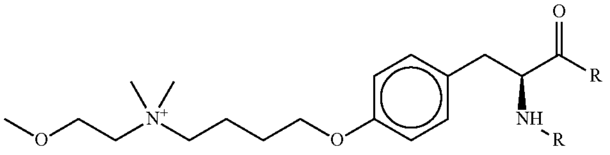 C18H29N2O3R2+ mPEG2TMA4F | C[N+](C)(CCCCOc1ccc(C[C@@H](C([R])=O)N[R])cc1)CCOC | |
| 264 | 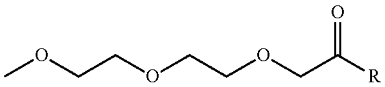 C7H13O4R mPEG3CO | COCCOCCOCC([R])=O | |
| 265 | 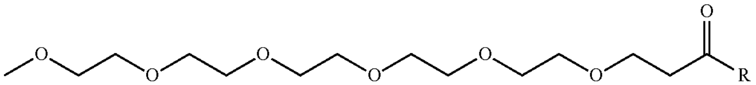 C14H27O7R mPEG6CO | COCCOCCOCCOCCOCCOCCC([R])=O | |

General Peptide Synthetic Procedure 1

IL-23R inhibitor compounds described herein were synthesized from amino acids monomers using Merrifield solid phase synthesis techniques on Protein Technology's Symphony multiple channel synthesizer. The peptides were assembled using HBTU (0-Benzotriazole-N,N,N',N'-tetramethyl-uronium-hexafluoro-phosphate), Diisopropylethylamine(DIEA) coupling conditions. For some amino acid couplings PyAOP(7-Azabenzotriazol-1I-yloxy) tripyrrolidinophosponium hexafluorophosphate) and DIEA conditions were used. Rink Amide MBHA resin (100-200 mesh, 0.57 mmol/g) was used for peptide with C-terminal amides and pre-loaded Wang Resin with N-α-Fmoc protected amino acid was used for peptide with C-terminal acids. The coupling reagents (HBTU and DIEA premixed) were prepared at 100 mmol concentration. Similarly, amino acids solutions were prepared at 100 mmol concentration. Peptide inhibitors of the present invention were identified based on medical chemistry optimization and/or phage display and screened to identify those having superior binding and/or inhibitory properties.

Preparation of Certain Modified Amino Acids

Certain modified amino acids appear in the sequences of the IL-23R inhibitors described herein. Those modified amino acids, and their precursors suitable for synthesizing the inhibitors described herein may be obtained from commercial sources, syntesized as described in the art, or by any suitable route. For example, substituted tryptophans may be prepared by any suitable route. Preparation of certain substituted tryptophans including those substituted at the seven position, such as 7-alkyl-tryptophans (e.g., 7-ethyl-L-tryptophans), which along with other substituted tryptophans, are described in, for example WO 2021/146441 A1. The synthesis of certain additional modified amino acids are described herein below.

a. Synthesis of (S)-5-(4-(2-((((9H-fluoren-9-yl) methoxy)carbonyl)amino)-2-carboxvethyl)phenoxy)-N,N,N-trimethylpentan-1-aminium (TMAPF)

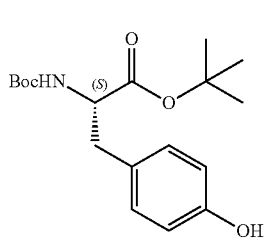

1

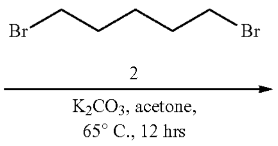

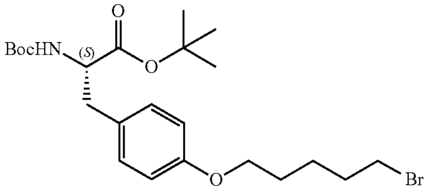

3

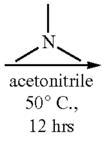

-continued

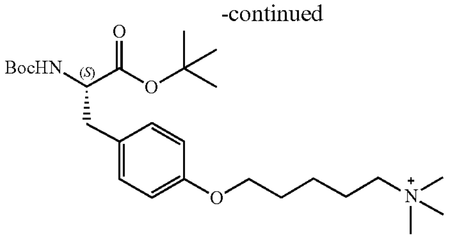

4

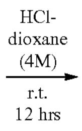

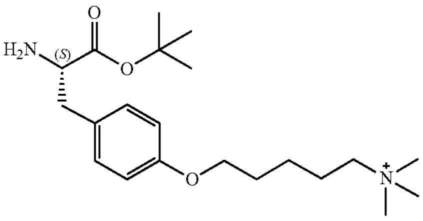

5

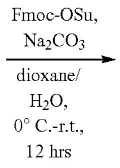

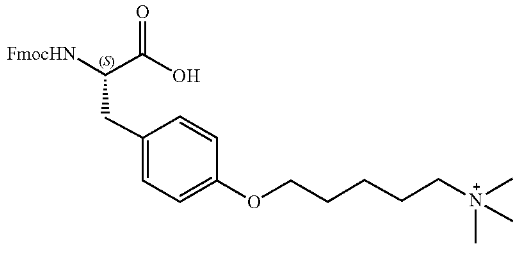

6

To a mixture of 1 (6.60 g, 19.7 mmol), $K_2CO_3$ (4.09 g, 29.6 mmol) and acetone (50 mL) was added 2 (4.99 g, 21.7 mmol). The reaction mixture was heated to refluxed and stirred for 12 hours. The reaction mixture was poured into water (500 mL) and extracted with ethyl acetate (500 mL×3). The combined organic extracts were washed with brine (500 mL), dried over anhydrous $Na_2SO_4$, filtered and concentrated under reduced pressure to afford the crude product, which was purified by FCC (eluent: petroleum ether: ethyl acetate=1:0 to 5:1) to afford crude product 3 (5.26 g, yield: 54.8%) as pale colourless oil. MS (ESI): mass calculated for $C_{23}H_{36}BrNO_5$, 486.44, m/z found 509.9 [M+23]+. $^1$H NMR (400 MHz, $CDCl_3$): δ ppm 7.07 (d, J=8.4 Hz, 2H), 6.81 (d, J=8.6 Hz, 2H), 4.97 (br d, J=8.2 Hz, 1H), 4.36-4.48 (m, 1H), 3.95 (t, J=6.3 Hz, 2H), 3.45 (t, J=6.8 Hz, 2H), 3.00 (br d, J=3.7 Hz, 2H), 1.87-2.01 (m, 2H), 1.76-1.86 (m, 2H), 1.62-1.69 (m, 2H), 1.42 (d, J=2.8 Hz, 18H).

To a mixture of 3 (5.26 g, 10.8 mmol) in acetonitrile (50 mL) was added trimethylamine in acetonitrile (2 M, 8.11 mL). The reaction mixture was stirred for 12 hours at 50° C. The reaction mixture was concentrated under reduced pressure to obtain the product 4 (5.0 g, yield: 99.3%) as pale-yellow solid.

MS (ESI): mass calculated for $C_{26}H_{45}N_2O_5$, 465.646, m/z found 465.2 $[M]^+$. The mixture of 4 (4.00 g, 8.59 mmol) in 4M HCl-dioxane (43.0 mL, 172 mmol) was stirred for 12 hours at room temperature. The solvent was removed under reduced pressure to obtain the product 5 (3.00 g, yield: crude) as a white solid, which was used to next step directly. MS (ESI): mass calculated For $C_{17}H_{29}N_2O_3$, 309.424, m/z found 309.1 $[M+H]^+$.

Compound 5 (3.00 g, 8.67 mmol) was dissolved in dioxane (20 mL) and water (20 mL) in a round-bottom flask. $Na_2CO_3$ (1.38 g, 13.0 mol) was added, and the solution cooled to 0° C. in an ice bath. Then Fmoc-OSu (3.22 g, 9.54 mol) was dissolved in dioxane (20 mL) and added in portions to the solution at 0° C. The reaction was stirred for 2 hours at 0° C. The reaction was allowed to warm to room temperature overnight. The reaction was acidized with 2N HCl (50 mL). The reaction mixture was purified by preparative HPLC using a Xtimate C18 150*40 mm*5 μm (eluent: 20% to 50% (v/v) $CH_3CN$ and $H_2O$ with 0.05% HCl) to afford product. The product was suspended in water (40 mL), the mixture frozen using dry ice/ethanol, and then lyophilized to dryness to afford the title compound 6 (TMAPF, 3.57 g, yield: 61.9%, purity: 99.2%) as pale-yellow solid. MS (ESI): mass calculated For $C_{32}H_{39}N_2O_5$, 531.662, m/z found 531.4 $[M+H]^+$. $^1H$ NMR (400 MHz, DMSO-$d_6$) δ ppm 7.89 (d, J=7.6 Hz, 2H), 7.73 (d, J=8.2 Hz, 1H), 7.65 (t, J=7.2 Hz, 2H), 7.39-7.43 (m, 2H), 7.27-7.34 (m, 2H), 7.19 (d, J=8.2 Hz, 2H), 6.78-6.89 (m, 2H), 4.06-4.25 (m, 4H), 3.84-3.99 (m, 2H), 3.25-3.37 (m, 2H), 3.05 (s, 9H), 3.00 (d, J=4.0 Hz, 1H), 2.70-2.84 (m, 1H), 1.63-1.82 (m, 4H), 1.30-1.46 (m, 2H)

b. Synthesis of (S)-2-((((9H-fluoren-9-yl)methoxy)carbonyl)amino)-3-(7-(3-acetamidophenyl)-1H-indol-3-yl)propanoic acid (7-(3—Nacetyl-phenyl)-tryptophan or 7(3NAcPh)W)

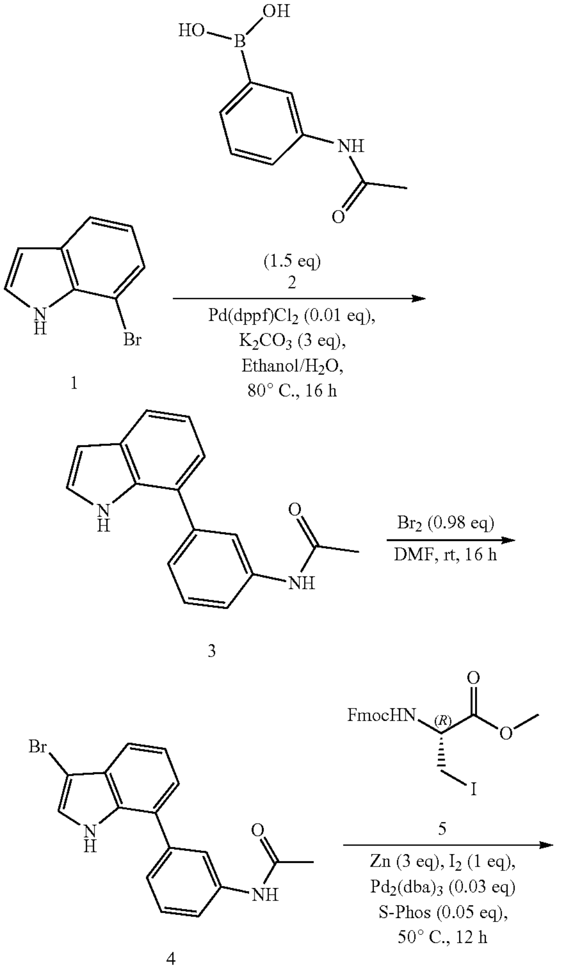

1 2 3 4 5

-continued

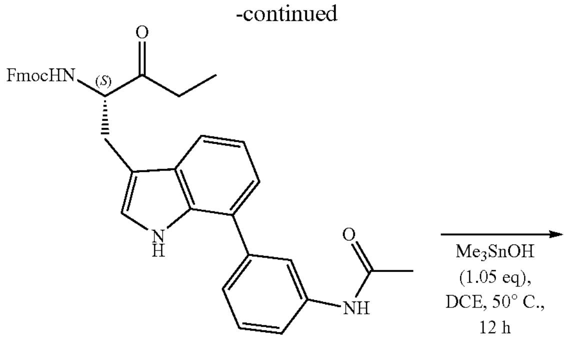

6

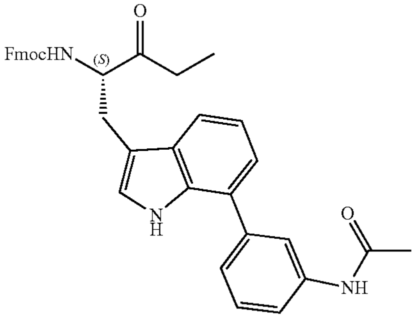
7

To a solution of 1 (30.0 g, 153 mmol), compound 2 (41.1 g, 230 mmol) and $K_3PO_4$ (97.4 g, 459 mmol) in $H_2O$/ethanol (500 mL) and, Pd(dppf)$Cl_2$ (1.12 g, 1.53 mmol) was added under an $N_2$ atmosphere. The mixture was stirred at 80° C. for 16 h. The mixture was filtered.

The mixture was concentrated, then extracted with ethyl acetate (500 mL×2), dried with anhydrous $Na_2SO_4$. The organic layer was concentrated and purified by FCC (eluent: petroleum ether/ethyl acetate=1:0 to 55:45) to give 3 (25.0 g, yield: 62.5%) as yellow oil MS (ESI): mass calculated for $C_{16}H_{14}N20$, 250.295, m/z found 251.0 [M+].

To a 1 L round-bottomed flask containing a solution of 3 (12.0 g, 47.9 mmol) in DMF (300 mL) bromine ($Br_2$, 2.422 mL, 47.0 mmol) was slowly added. The mixture was stirred at 25° C. for 16 hours. The solution was added to aqueous sodium sulfite (500 mL), the mixture was stirred at 25° C. for 2 hours. The mixture was filtered, the filter cake was mixed with $H_2O$ (400 mL) and stirred at 25° C. for 1 h. The mixture was filtered, the solid was collected to give 4 as a crude product, which was purified by preparative high-performance liquid chromatography (Column: Phenomenex C18 250×50 mm×10 μm, Condition: water (FA)-CAN (20%-60%)).

The mixture was concentrated, extracted with $CH_2Cl_2$ (1 L×2), washed with brine, dried with anhydrous $Na_2SO_4$. The organic layers were filtered and concentrated to give 4 (9.70 g, yield: 60.8%) as a pale white. MS (ESI): mass calculated For $C_{16}H_{13}BrN_2O$, 329.191, m/z found 328.8 [M].

A 250 mL three neck round-bottomed flask was charged with activated Zn powder (5.84 g, 89.3 mmol), DMF (120 mL) and $I_2$ (382 mg, 1.50 mmol) was added under an $N_2$ atmosphere at room temperature. After stirring for 20 min, a solution of 5 (13.6 g, 30.1 mmol) in DMF (30 mL) was added to the mixture. The reaction mixture was stirred for 30 min. at room temperature, after which 4 (9.70 g, 29.5 mmol), tris(dibenzylideneacetone)palladium (826 mg, 0.902 mmol), 2-dicyclohexylphosphino-2',6'-dimethoxybiphenyl (617 mg, 1.50 mmol) were added under an $N_2$ atmosphere. The reaction mixture was stirred at 50° C. for 12 hours, after which solvent was removed under reduced pressure to give crude product 6. The crude product was extracted with ethyl acetate (1500 mL). The extract was washed with $H_2O$ (500 mL×2), followed by brine (500 mL), after which it was dried over anhydrous $Na_2SO_4$, filtered, and concentrated to dryness in vacuo to give crude intermediate 6, which was purified by silica gel chromatography (0-100% ethyl acetate/petroleum ether (EtOAc/PE)) to afford 6 (11.0 g, yield: 63.8%) as a brown-yellow oil. MS (ESI): mass calculated for $C_{35}H_{31}N_3O_5$, 573.638, m/z found 574.1 [M+1].

Intermediate 6 (11.0 g, 19.2 mmol), a stir bar, $Me_3SnOH$ (3.64 g, 20.1 mmol) and DCE (150 mL) were added to a 250 mL round-bottomed flask and stirred at 50° C. for 12 hours. To the reaction mixture 2 N HCl was added to adjust the to pH to 6. A second reaction series starting with a solution of 1 was prepared and the combined reaction mixtures were concentrated under reduced pressure to give the crude product 7, which was purified by preparative HPLC using a Xtimate C18 150×40 mm x Sum (eluent: 38% to 68% (v/v) $CH_3CN$ and $H_2O$ with 0.05% HCl) to afford product 7. The product was suspended in water (100 mL), the mixture frozen using dry ice/ethanol, and then lyophilized to dryness to afford 7 (7(3NAcPh)W, 11.8 g, yield: 66.8%) as a white solid. MS (ESI): mass calculated For $C_{34}H_{29}N_3O_5$, 559.611, m/z found 560.0 [M+1]. $^1H$ NMR DMSO-$d_6$ (400 MHz) δ 10.73 (s, 1H), 10.10 (s, 1H), 7.52-8.02 (m, 7H), 6.96-7.52 (m, 9H), 4.03-4.44 (m, 3H), 3.25 (d, J=13.2 Hz, 2H), 3.01-3.15 (m, 1H), 2.08 (s, 3H).

c. Synthesis of (S)-2-((((9H-fluoren-9-yl)methoxy)carbonyl)amino)-3-(6-(tert-butoxy)naphthalen-2-yl)propanoic acid (5-methyl-pyridyl-alanine or 5MePyridinAla)

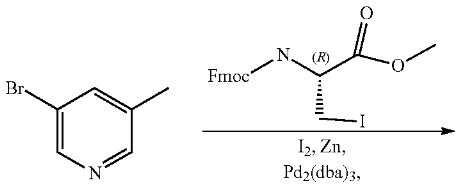

1

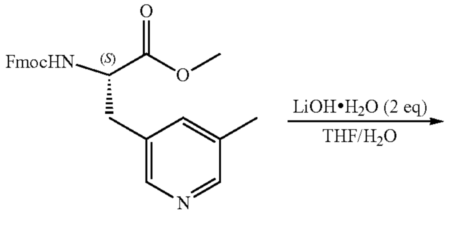

2

-continued

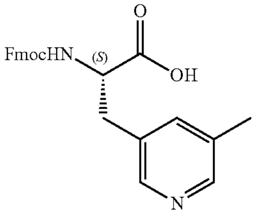

3

Activated Zn powder (8.18 g, 125 mmol), DMF (150 mL) and $I_2$ (0.534 g, 2.11 mmol) were stirred under an $N_2$ atmosphere at room temperature for 20 min, after which (R)-methyl 2-((((9H-fluoren-9-yl)methoxy)carbonyl)amino)-3-iodopropanoate (19.0 g, 42.1 mmol) in DMF (25 mL) was added. The reaction mixture was stirred for 30 min at room temperature, after which a mixture of 1 (7.97 g, 46.3 mmol), tris(dibenzylideneacetone)palladium (1.16 g, 1.26 mmol) and 2-dicyclohexylphosphino-2',6'-dimethoxybiphenyl (0.864 g, 2.11 mmol) in DMF (25 mL) was added under an $N_2$ atmosphere. The resulting reaction mixture was stirred at 50° C. for 12 h. The solvent was removed under reduced pressure to give the crude, which was purified by FCC (eluent: petroleum ether: ethyl acetate=1:0 to 0:1 and ethyl acetate: methanol=1:0 to 2:1) to afford the product 2 (10.00 g, 57.0% yield) as pale-yellow liquid. MS (ESI): mass calculated for $C_{25}H_{24}N_2O_4$, 416.469, m/z found 417.1 $[M+H]^+$.

To a mixture of 2 (9.50 g, 22.8 mmol) in THF (100 mL) was added $LiOH·H_2O$ (1.91 g, 45.6 mmol) in $H_2O$ (10 mL). The mixture was stirred for 1 h at 0° C. TLC showed most SM were consumed. To the reaction mixture was added HCl (1 N) dropwise at ice bath to pH=5. The reaction mixture was concentrated under reduced pressure, then poured into water (200 mL) the mixture was extracted with THF (200 mL×3). The organic layers were combined, washed with brine (100 mL), dried over anhydrous $Na_2SO_4$. After filtering the organic layers were concentrated under reduced pressure to afford crude product 3, which was purified by FCC (eluent: ethyl acetate: methanol=1:0 to 2:1) to obtain 3 (5MePyridinAla, 6.716 g, yield: 72.3%) as a white powder. MS (ESI): mass calculated For $C_{24}H_{22}N_2O_4$, 402.442, m/z found 403.1 $[M+H]^+$. $^1H$ NMR DMSO-d6 (Bruker 400 MHz): δ 8.18 (s, 2H), 7.88 (d, J=7.6 Hz, 2H), 7.63 (d, J=7.2 Hz, 2H), 7.45-7.26 (m, 5H), 6.81 (s, 1H), 4.33-4.21 (m, 1H), 4.20-4.09 (m, 2H), 3.95 (s, 1H), 3.06-3.05 (m, 1H), 2.92-2.89 (m, 1H), 2.18 (s, 3H).

d. Synthesis of (S)-2-((((9H-fluoren-9-yl)methoxy)carbonyl)amino)-3-(4-(2-(3-((2,2,4,6,7-pentamethyl-2,3-dihydrobenzofuran-5-yl)sulfonyl)guanidino)ethoxy)phenyl)propanoic acid (AEF(G)

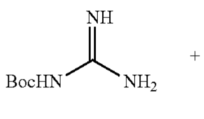

1

-continued

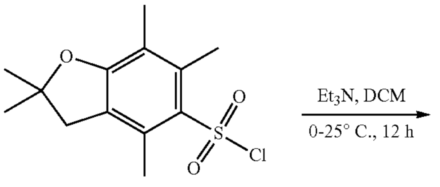

2

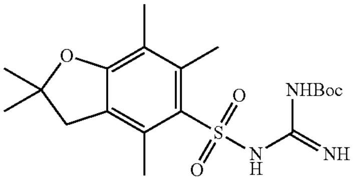

3

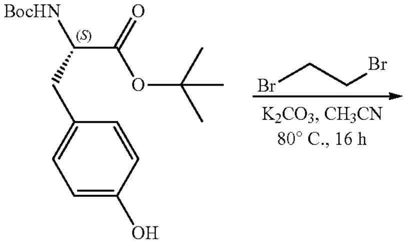

4

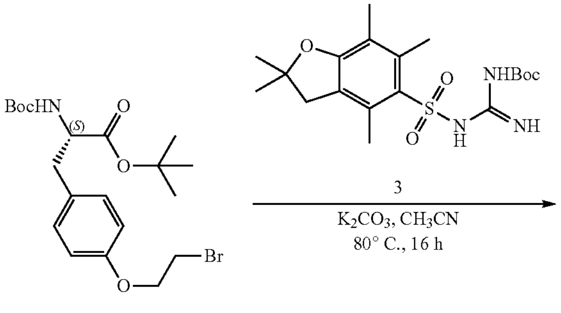

5

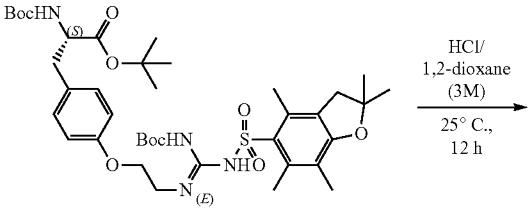

6

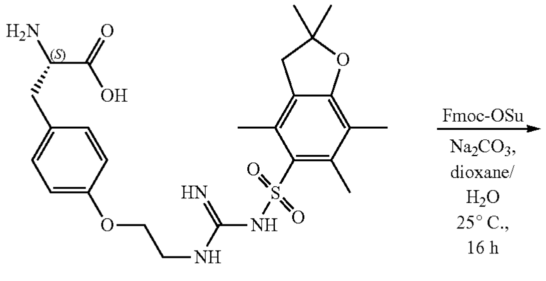

7

-continued

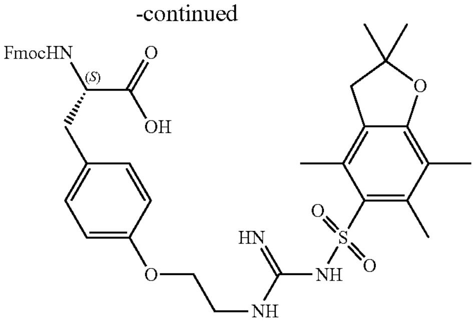

8

Starting material 1 (9.9 g, 62.2 mmol), a stir bar, $Et_3N$ (14 mL, 101 mmol), and dichloromethane (DCM, 250 mL) were added to a 500 mL round-bottomed flask. The resulting mixture was treated with 2 (10 g, 34.6 mmol) in portions under ice-water bath. Then the reaction mixture was stirred at 25° C. for 12 hours. The reaction mixture was diluted with $H_2O$ (800 mL), extracted with DCM (400 mL×2). The organic phase extracts were combined, washed with brine (800 mL), and concentrated to give the crude intermediate 3 as a yellow solid. The crude intermediate was triturated with ethyl acetate (50 mL) and the suspension isolated via filtration. The filter cake was washed with ethyl acetate (20 mL×3) before drying under reduced pressure to give the 3 (7.12 g, 49%) as a white solid. MS (ESI): mass calculated for $C_{19}H_{29}N_3O_5S6$, 411.5, m/z found 412.1 $[M+H]^+$.

Starting material 4 (50.0 g, 148 mmol), a stir bar, DMF (300 mL), and $K_2CO_3$ (102 g, 739 mmol) were added to a nitrogen-purged 1000 mL round-bottomed flask. The flask was subsequently evacuated and refilled with nitrogen (x 3), after which 1,2-dibromoethane (154 mL, 1.78 mol) was added, and the resulting mixture was stirred at 80° C. for 16 h under a $N_2$ atmosphere. The reaction mixture was filtered and concentrated to dryness under reduced pressure to give the crude product, which was subjected to silica gel chromatography (eluent: EtOAc: pet ether=0-60%) to give the 5 (64 g, 96%) as a light-yellow oil. MS (ESI): mass calculated for $C_{20}H_{30}BrNO_5$, 444.36, m/z found 466.1 $[M+Na]^+$.

Intermediate 5 (6.1 g, 13.7 mmol), 3 (6.2 g, 15.1 mmol), $K_2CO_3$ (7.6 g, 55.0 mmol), a stir bar, and $CH_3CN$ (100 mL) were charged into a 250 mL round-bottomed flask. The reaction mixture was stirred at 80° C. for 16 h under a $N_2$ atmosphere. The reaction mixture was cooled to room temperature, diluted with $H_2O$ (200 mL), extracted with ethyl acetate (100 mL×2). The organic phases were combined and washed with brine (300 mL) and concentrated to give the crude intermediate 6. The crude intermediate was purified by flash column chromatography (FCC, eluent: ethyl acetate/petroleum ether=0:1 to 2:1) to give the 6 (6.62 g, 44.2%) as a white solid. MS (ESI): mass calculated for $C_{39}H_{58}N_4O_{10}S$, 774.9, m/z found 775.5 $[M+H]^+$.

Intermediate 6 (6.6 g, 8.52 mmol), HCl/1, 4-dioxane (90 mL, 4M), a stir bar, and 1, 4-dixoane (30 mL) were charged into a 250 mL round bottomed flask. The resulting mixture was stirred at 25° C. for 12 hr. The solvent was removed under reduced pressure to give intermediate 7 (7.8 g, crude product) as a colourless oil, which was directly used to next step. MS (ESI): mass calculated for $C_{25}H_{34}N_4O_6S$, 518.6, m/z found 519.2 $[M+H]^+$.

Intermediate 7 (7.80 g, 15.0 mmol), a stir bar, $Na_2CO_3$ (3.19 g, 30.1 mmol), Fmoc-OSu (5.58 g, 16.5 mmol), 1, 4—dioxane (50 mL), and $H_2O$ (50 mL) were added into a 250 mL round-bottomed flask at 25° C. The reaction mixture was stirred at 25° C. for 16 hours, after which it was adjusted to pH=5-6 with HCl (2M) and the resulting reaction mixture was extracted with EtOAc (150 mL×3). The organic phases from the extraction were combined and washed with brine (200 mL) and concentrated to give the crude intermediate 7. The crude intermediate was purified by preparative HPLC with a Column: Phenomenex C18 150×40 mm×5 μm, (eluent: 42% to 72% (v/v) $CH_3CN$ and $H_2O$ with 0.1% HCl) to afford pure product. The product was suspended in water (100 mL), the mixture frozen using dry ice/ethanol, and then lyophilized to dryness to afford desired product 8 (AEF(G), 4 g, 36%) as a white solid. MS (ESI): mass calculated for $C_{40}H_{44}N_4O_8S$, 740.9, m/z found 741.3 $[M+H]^+$. $^1H$ NMR (400 MHz, DMSO-$d_6$): 7.87 (d, J=7.2 Hz, 2H), 7.71-7.62 (m, 2H), 7.39 (td, J=4.0, 7.2 Hz, 2H), 7.29 (td, J=7.6, 12.0 Hz, 2H), 7.14 (br d, J=8.0 Hz, 2H), 6.99-6.85 (m, 1H), 6.77 (br d, J=8.4 Hz, 2H), 6.59-6.50 (m, 1H), 4.21-4.06 (m, 4H), 3.88 (br s, 2H), 3.42-3.36 (m, 4H), 2.99 (br dd, J=4.4, 14.0 Hz, 1H), 2.92 (s, 2H), 2.78 (br dd, J=10.8, 13.6 Hz, 1H), 2.47 (br s, 3H), 2.41 (s, 3H), 1.97 (s, 3H), 1.38 (s, 6H).

e. Synthesis of 2-(2-(2-carboxvethoxy)ethoxy)-N,N,N-trimethylethan-1-aminium (cPEG3a) IDC-39C3

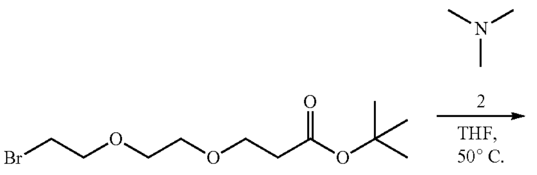

1

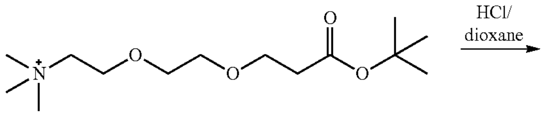

3

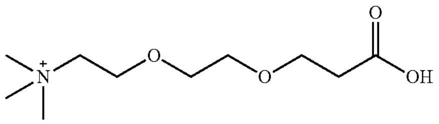

4

A mixture 1 (5.00 g, 16.8 mmol) and trimethylamine 2 (25 mL, 50 mmol, in THF) in dry THF (10 mL) was stirred for 16 hours at 50° C. under $N_2$. The mixture was concentrated to give the product 3 (6.0 g, yield: 99.8%) as yellow oil. $^1H$ NMR (DMSO-$d_6$, 400 MHz): δ3.88-3.79 (m, 2H), 3.64-3.48 (m, 8H), 3.12 (s, 9H), 2.42 (t, J=6.4 Hz, 2H), 1.39 (s, 9H). A mixture of 3 (6.00 g, 16.8 mmol) and HCl/dioxane (60 mL, 240 mmol) was stirred for 16 hours at 25° C. under $N_2$. The mixture was concentrated to give the product 4 (cPEG3a, 4.3 g, yield: 99.8%) as yellow oil. $^1H$ NMR ($D_2O$, 400 MHz): δ3.96-3.87 (m, 2H), 3.74 (t, J=5.6 Hz, 2H), 3.64 (s, 4H), 3.57-3.49 (m, 2H), 3.12 (s, 9H), 2.60 (t, J=5.6 Hz, 2H).

f. Synthesis of (S)-2-(2-(2-(4-(2-((((9H-fluoren-9-yl)methoxy)carbonyl)amino)-2-carboxvethyl)phenoxy)ethoxy)ethoxy)-N,N,N-trimethylethan-1-aminium (APEG3F)

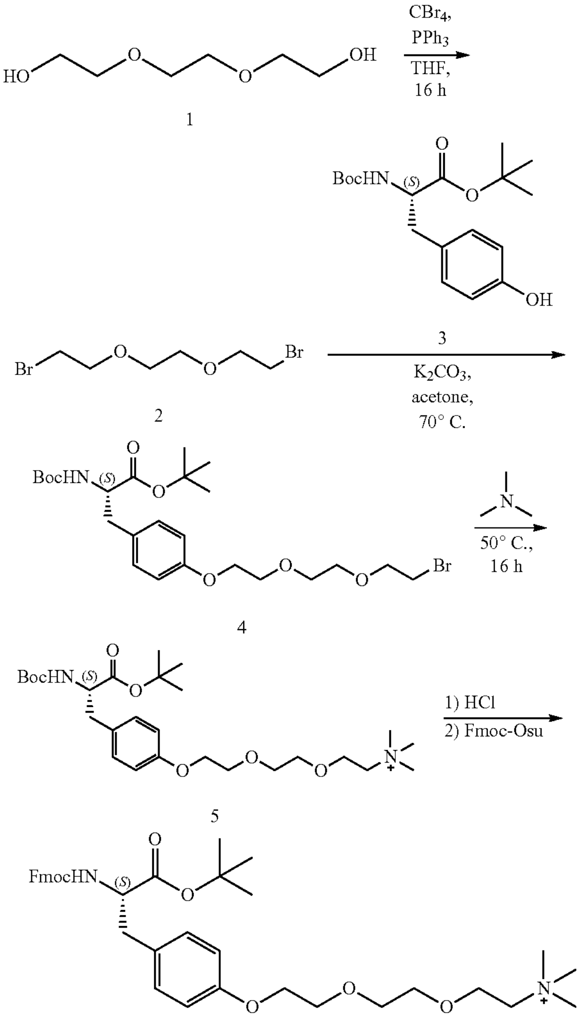

To a mixture of 1 (50.0 g, 333 mmol) in THF (1.3 L) was added PPh3 (188 g, 716 mmol), after which CBr4 (243 g, 732 mmol) was very slowly added to the mixture at 0° C. The mixture was stirred at room temperature overnight (16 h) and then concentrated under reduced pressure to give the crude intermediate 2. Petroleum ether (2.0 L) and ethyl acetate (200 mL) were added to the mixture and stirred at 25° C. for 0.5 h. The mixture was filtered, concentrated under reduced pressure, and purified by FCC (eluent: petroleum ether: ethyl acetate=1:0 to 1:9) to give intermediate 2 (52 g, yield: 56.6%) as colorless oil. $^1H$ NMR (400 MHz, Chloroform-d): 3.91-3.81 (m, 4H), 3.75-3.68 (m, 4H), 3.55-3.46 (m, 4H).

To a solution of 3 (45.9 g, 136 mmol) and K2CO3 (56.3 g, 408 mmol) in acetone (1 L) was added 2 (75.0 g, 272 mmol) under a nitrogen atmosphere. The mixture was stirred at 70° C. for 16 h. The mixture was filtered and evaporated, and the residue was purified by flash column chromatography FCC (eluent: petroleum ether: ethyl acetate=1:0 to 1:9) to give the intermediate 4 (45 g, yield: 61.6%) as a pale-yellow oil. MS (ESI): mass calculated for $C_{24}H_{38}BrNO_7$, 532.47, m/z found 433.8 $[M-100]^+$.

A solution of 4 (51 g, 96 mmol) in trimethylamine (239 mL, 2 M, in THF), was stirred at 50° C. for 16 h. The mixture was concentrated under reduced pressure to give the crude intermediate 5 (56 g, crude) as pale-yellow oil, which was used in the next step without purification. MS (ESI): mass calculated for $C_{27}H_{47}N_2O_7+$, 511.67, m/z found 511.4 $[M]^+$ A mixture of 5 (56.0 g, 94.7 mmol) in HCl/dioxane (592 mL, 4 M) was stirred at 25° C. for 16 h, after which it was concentrated under reduced pressure, dissolved in $H_2O$ (200 mL), and quenched with an aqueous solution of $Na_2CO_3$ at 0° C. to adjust pH=7. Then $Na_2CO_3$ (15.0 g, 142 mmol) and Fmoc-OSu (31.9 g, 94.4 mmol) in acetone (150 mL) were added under a nitrogen atmosphere and stirred at 25° C. for 3 h. The mixture was acidified with 2 M HCl, adjusted to pH=4 and concentrated under reduced pressure. The mixture was extracted with ethyl acetate (300 mL×2). The aqueous phase was concentrated under reduced pressure to give crude product 6 ($H_2O$ solution), which was purified by preparative HPLC using a Phenomenex Gemini Xtimate C18 150*40 mm*5 μm, 100A (eluent: 53% to 83% (v/v) water (0.225% FA)-ACN) to afford the title compound 6 (APEG3F, 43 g, yield: 78.8%) as an off-white solid. MS (ESI): mass calculated for $C_{18}H_{31}N_2O_5$, 355.45, m/z found 355.1 $[M]^+$. $^1H$ NMR (400 MHz, DMSO-$d_6$) δ 8.40 (s, 1H), 7.88 (d, J=7.6 Hz, 2H), 7.66 (d, J=7.2 Hz, 2H), 7.44-7.36 (m, 2H), 7.31 (q, J=7.2 Hz, 2H), 7.18-7.04 (m, 3H), 6.77 (d, J=8.4 Hz, 2H), 4.24-4.13 (m, 3H), 4.00 (d, J=3.6 Hz, 3H), 3.81 (s, 2H), 3.73-3.67 (m, 2H), 3.58 (s, 4H), 3.54-3.48 (m, 2H), 3.07 (s, 9H), 3.05-2.98 (m, 1H), 2.85-2.76 (m, 1H).

f. Synthesis of N2-(((9H-fluoren-9-yl)methoxy) carbonyl)-N4,N4-dimethyl-L-asparagine (N(N(Me) 2)

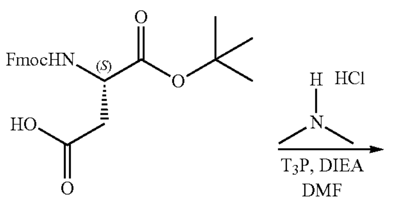

1

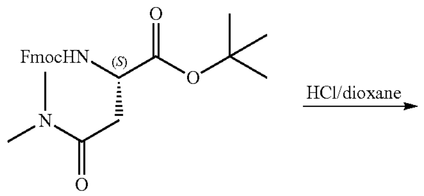

2

-continued

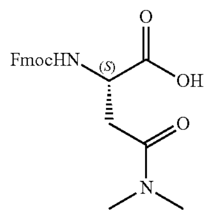

3

To a solution of starting material 1 (50 g, 122 mmol), dimethylamine (10.9 mg, 134 mmol), and diisopropyl ethyl amine (DIEA, 62.0 g, 365 mmol) in DMF (200 mL) at 0° C. was degassed with $N_2$ three times and propylphosphonic anhydride ($T_3P$®, 109 g, 182 mmol) was added via syringe. The mixture was stirred at 20° C. for 12 hours after which it was poured into ice water (500 mL) and extracted with ethyl acetate (500 mL×3). The combined organic extracts were washed with brine, dried over anhydrous $Na_2SO_4$, filtered, and concentrated under reduced pressure to afford the crude intermediate 2, which was purified by fast column chromatography (FCC, eluent: petroleum ether: ethyl acetate=1:0 to 1:2) to afford 2 (45 g, yield: 84.4%) as pale-yellow solid. MS (ESI): mass calculated for $C_{25}H_{30}N_2O_5$, 438.52, m/z found 439.2 $[M+H]^+$.

Intermediate 2 (45 g, 103 mmol) was stirred in HCl/dioxane (1L, 4 M) at 20° C. for 16 h. The reaction mixture was filtered and concentrated. EtOAc (200 mL) was added to the concentrated material after which petroleum ether (200 mL) was added dropwise. The mixture was stirred at 20° C. for 3 h resulting in a solid that was filtered to afford 3 (N(N(Me)2), 25 g, yield: 62.3%) as white solid. MS (ESI): mass calculated for $C_{21}H_{22}N_2O_5$, 382.41, m/z found 383.1 $[M+H]^+$. $^1H$ NMR (DMSO-$d_6$, 400 MHz): δ ppm 12.59 (s, 1H), 7.86 (d, J=7.6 Hz, 2H), 7.67 (d, J=7.2 Hz, 2H), 7.43-7.21 (m, 5H), 4.39-4.31 (m, 1H), 4.29-4.23 (m, 2H), 4.21-4.15 (m, 1H), 2.90 (s, 3H), 2.78 (s, 3H), 2.75-2.62 (m, 2H).

g. Synthesis of N2-(((9H-fluoren-9-yl)methoxy) carbonyl)-N6-acetyl-N6-methyl-L-lysine (Lysine N-(MeAc) or K(NMeAc))

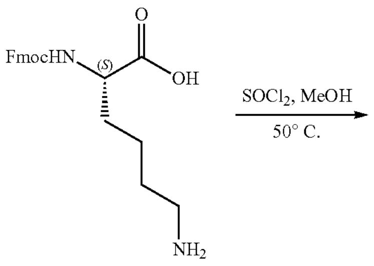

1

-continued

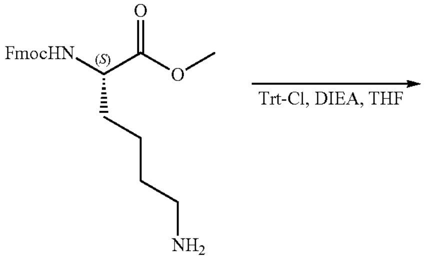

2

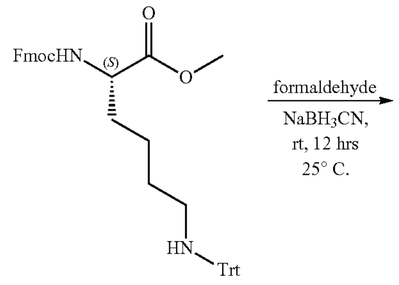

3

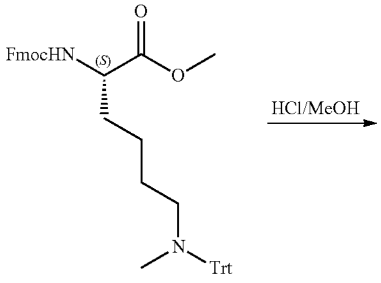

4

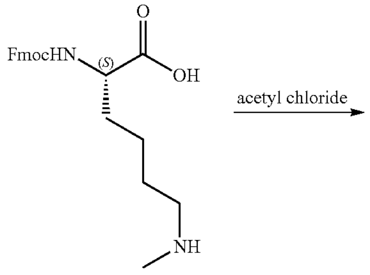

5

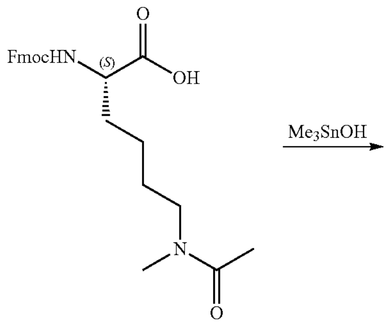

6

-continued

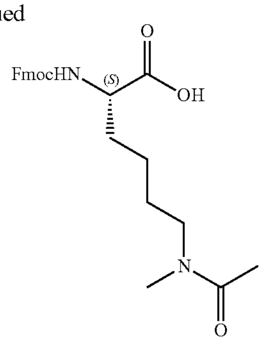

Fmoc-K(NMeAc)
7

Starting material 1 (21 g, 57.0 mmol) and MeOH (300 mL) were combined in a flask under a $N_2$ atmosphere. Thionyl chloride (8.14 g, 68.4 mmol) was added to the flask dropwise over 15 minutes at a temperature of 25° C. resulting in a pale-yellow mixture. The mixture was heated at reflux for 4 h. The resulting yellow solution was concentrated in vacuo. Ethyl acetate (50 mL) was added to the concentrated material and the mixture was stirred at 250 C for 1 h. The solid was filtered to afford crude intermediate 2 (23 g, crude) as white solid. MS (ESI): mass calculated for $C_{22}H_{26}N_2O_4$, 382.45, m/z found 383.5 $[M+H]^+$.

To a solution of 2 (6.1 g, 14.6 mmol) and TEA (4.41, 43.7 mmol) in 100 mL of anhydrous $CH_2Cl_2$/THF (100 mL) was added trityl chloride (Trt-C1, 4.47 g, 16.0 mmol). The reaction mixture was stirred at 20° C. for 2 h. The reaction mixture was diluted with water (80 mL), extracted with ethyl acetate (100 mL×2), washed with brine (20 mL) and dried over $Na_2SO_4$. The combined organic extracts were filtered and concentrated under reduced pressure to afford the crude intermediate 3, which was purified by FCC (eluent: petroleum ether: ethyl acetate=1:0 to 1:2) to afford 3 (7 g, yield: 76.7%) as pale-yellow solid. MS (ESI): mass calculated for $C_{41}H_{40}N_2O_4$, 624.77, m/z found 647.3 $[M+Na]^+$. $^1H$ NMR (DMSO-$d_6$, 400 MHz): δ ppm 7.84 (d, J=7.5 Hz, 2H), 7.71 (d, J=7.7 Hz, 1H), 7.66 (d, J=6.8 Hz, 2H), 7.36 (d, J=7.3 Hz, 9H), 7.29-7.20 (m, 8H), 7.17-7.08 (m, 3H), 4.29-4.22 (m, 2H), 4.21-4.11 (m, 1H), 3.97-3.91 (m, 1H), 3.56 (s, 3H), 2.56-2.50 (m, 1H), 1.91 (d, J=6.2 Hz, 2H), 1.55 (m, 2H), 1.46-1.31 (m, 2H), 1.26 (d, J=7.5 Hz, 2H).

A solution of 3 (5.20 g, 8.32 mmol), formaldehyde (20.3 g, 250 mmol) and $NaBH_3CN$ (2.62 g, 41.6 mmol) in methanol (100 mL) was stirred at 25° C. for 16 hours. The mixture was quenched with water (100 mL), extracted with dichloromethane (200 mL×3), the organic layer was dried over anhydrous $Na_2SO_4$, filtered, and concentrated under reduced pressure. The residue was purified by flash chromatography (FCC, eluent: petroleum ether: ethyl acetate=1:0 to 1:9) to afford 4 (2.7 g, yield: 41.2%) as pale-yellow solid. MS (ESI): mass calculated For $C_{42}H_{42}N_2O_4$, 638.79, m/z found 661.1$[M+Na]^+$.

Intermediate 4 (80 g, 125 mmol) was dissolved in HCl/MeOH (800 mL) and stirred at 20° C. for 1 h. The reaction mixture was concentrated under reduced pressure to afford the crude product. Ethyl acetate (100 mL) and petroleum ether (200 mL) were added, and the reaction mixture was stirred at 20° C. for 4 h. The solid was filtered to afford intermediate 5 (60 g, crude) as pale-yellow solid. MS (ESI): mass calculated for $C_{23}H_{28}N_2O_4$, 396.48, m/z found 397.1 $[M+H]^+$.

To a solution of 5 (120 g, 277 mmol) in $CH_2Cl_2$ (1200 mL) was added TEA (107 g, 832 mmol) at 0° C. Acetyl chloride (26.1 g, 333 mmol) was added, and the reaction mixture was stirred at 20° C. for 2 h. The reaction mixture was diluted with water (300 mL), extracted with $CH_2Cl_2$ (500 mL×2), washed with brine, and dried over $Na_2SO_4$. The combined organic extracts were filtered and concentrated under reduced pressure to afford crude intermediate 6, which was purified by FCC (eluent: petroleum ether: ethyl acetate=1:0 to 1:2) to afford 6 (67 g, yield: 38.0%) as pale yellow oil.MS (ESI): mass calculated For $C_{25}H_{30}N_2O_5$, 438.52, m/z found 439.6 $[M+H]^+$.

To a solution 6 (2.6 g, 5.93 mmol) in DCE (50 mL) was added Me3SnOH(1.61 g, 8.90 mmol) and stirred at 20° C. for 16 h. 1 M HCl (5 mL) was added dropwise at 0° C. The mixture was stirred at room temperature for 0.5 h, dried over $Na_2SO_4$, and filtered. The filtrate was concentrated, and the residue was purified by FCC (eluent: $CH_2Cl_2$: MeOH=1:0 to 95:5) to afford 7 (K(NMeAc), 2.02 g, yield: 80.51%) as pale-yellow solid. MS (ESI): mass calculated for $C_{24}H_{28}N_2O_5$, 424.49, m/z found 425.1 $[M+H]^+$. $^1H$ NMR (DMSO-$d_6$, 400 MHz): δ 7.89 (d, J=7.6 Hz, 2H), 7.73 (d, J=7.2 Hz, 2H), 7.62 (m, 1H), 7.46-7.38 (m, 2H), 7.36-7.28 (m, 2H), 4.33-4.16 (m, 3H), 3.89 (s, 1H), 3.22 (m, 2H), 2.93-2.73 (m, 3H), 1.94 (d, J=7.2 Hz, 3H), 1.77-1.55 (m, 2H), 1.55-1.36 (m, 2H), 1.28 (m, 2H).

h. Synthesis of (S)-2-amino-N-(2-(dimethylamino)-2-oxoethyl)-N-methyl-3-(pyridin-3-yl)propanamide (NH2-3Pva-Sar-CON(Me)2)

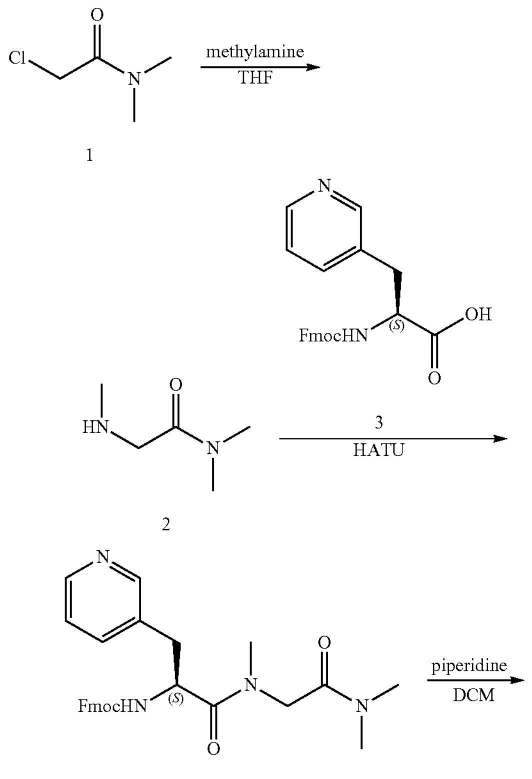

1
2
4

-continued

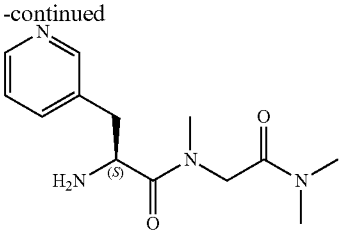
5

A 100-mL vial was charged with starting material 1 (10 g, 82.3 mmol) and a solution of methylamine (51.1 g, 494 mmol, 30% in ethanol) was added. The reaction mixture was stirred for 16 h at 25° C., after which the mixture was concentrated to give crude intermediate 2. To the crude intermediate, petroleum ether (30 mL) was added and the mixture was stirred at 25° C. for 0.5 h to yield a solid. The resulting solid was filtered to give 2 (10 g, crude) as a light-yellow solid. $^1H$ NMR (DMSO-d6, 400 MHz): δ ppm 9.09-8.02 (m, 2H), 3.97 (s, 2H), 2.92 (s, 3H), 2.87 (s, 3H), 2.52 (s, 3H).

To a stirred solution of compound 3 (9 g, 23.2 mmol), intermediate 2 (3.23 g, 27.81 mmol), and DIEA (7.03 g, 69.5 mmol) was added in DMF (90 mL) HATU (10.6 g, 27.8 mmol). The reaction mixture was stirred at 25° C. for 2 h then poured into ice water (100 mL) and extracted with ethyl acetate (200 mL×4). The combined organic extracts were washed with brine (100 mL), dried over anhydrous $Na_2SO_4$, filtered, and concentrated under reduced pressure to afford the crude intermediate 4, which was purified by FCC (eluent: $CH_2Cl_2$: MeOH=1:0 to 95:5) to afford 4 (11 g, yield: 96.5%) as pale-yellow solid. MS (ESI): mass calculated for $C_{28}H_{30}N_4O_4$, 486.56, m/z found 487.2 $[M+H]^+$.

To a solution of 4 (10.5 g, 21.6 mmol) in DCM (400 mL) was added piperidine (5 mL, 50.5 mmol). The reaction mixture was stirred at room temperature for 16 h under a nitrogen atmosphere, and then it was concentrated under vacuum. The residue was purified by FCC (eluent: $CH_2Cl_2$: MeOH=1:0 to 95:5) to afford crude product 5 (5.5 g, impure) as pale-yellow solid. Then crude product was purified by preparative HPLC using a Phenomenex Genimi NX C18 (150*40 mm*5 μm) (eluent: 1% to 25% (v/v) water (0.04% $NH_3H_2O$+10 mM $NH_4HCO_3$)-MeCN to afford pure product. The pure fractions were collected and lyophilized to dryness to give 5 (NH2-3Pya-Sar-CON(Me)2, 3.6 g, yield: 62.7%) as a gummy liquid. MS (ESI): mass calculated for $C_{13}H_{20}N_4O_2$, 264.32, m/z found 265.1 $[M+H]^+$. $^1H$ NMR (400 MHz, $D_20$) 6 ppm 8.44-8.22 (m, 2H), 7.76-7.54 (m, 1H), 7.34 (m, 1H), 4.31-4.19 (m, 1H), 4.18-3.96 (m, 2H), 2.95 (m, 3H), 2.92-2.85 (m, 6H), 2.77 (m, 2H).

i. Synthesis of (2-((((9H-fluoren-9-yl)methoxy)carbonyl)amino)-N-(carboxymethyl)-N,N-dimethylethan-1-aminium) chloride (Fmoc-SP6)

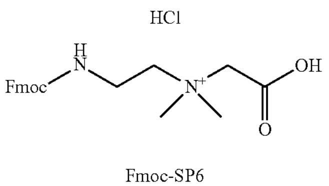
Fmoc-SP6

Tert-butyl (2-((((9H-fluoren-9-yl)methoxy)carbonyl)amino)ethyl)glycinate was dissolved in $H_2O$/ACN and $Na_2CO_3$ (3Eq) was added, followed by $CH_3I$ (10Eq). The mixture was stirred at RT. After 1 h, ACN was evaporated in vacuum and the mixture was extracted with EtOAc, then washed with water and brine. The organic extracts were dried on $Na_2SO_4$, filtered, concentrated to dryness. The crude mixture was dissolved in HCl 6M in dioxane and stirred for 6 hr at RT to remove the tButyl group. Solvent was evaporated, stripped several times with $Et_2O$ and lyophilized to afford intermediate compound Fmoc-SP6 ((2-((((9H-fluoren-9-yl)methoxy)carbonyl)amino)-N-(carboxymethyl)-N,N-dimethylethan-1-aminium)) chloride: LCMS anal. calc. For $C_{21}H_{25}N_2O_4$+: 369.44; found: 369.4; $^1$H NMR (400 MHz, DMSO-$d_6$) δ 3.20 (s, 6H) 3.39-3.48 (m, 2H) 3.57 (s, 2H) 4.20-4.27 (m, 1H) 4.38 (s, 1H) 4.33 (s, 2H) 4.31-4.36 (m, 1H) 7.30-7.38 (m, 2H) 7.40-7.46 (m, 2H) 7.59-7.64 (m, 1H) 7.65-7.71 (m, 2H) 7.90 (d, J=7.45 Hz, 2H).

Assembly

The peptides were assembled using standard Symphony protocols. The peptide sequences were assembled as follows: Resin (250 mg, 0.14 mmol) in each reaction vial was washed twice with 4 ml of DMF followed by treatment with 2.5 ml of 20% 4-methyl piperidine (Fmoc de-protection) for 10 min. The resin was then filtered and washed two times with DMF (4 ml) and re-treated with N-methyl piperifine for additional 30 minute. The resin was again washed three times with DMF (4 ml) followed by addition 2.5 ml of amino acid and 2.5 ml of HBTU-DIEA mixture. After 45 min of frequent agitations, the resin was filtered and washed three timed with DMF (4 ml each). For a typical peptide of the present invention, double couplings were performed. After completing the coupling reaction, the resin was washed three times with DMF (4 ml each) before proceeding to the next amino acid coupling.

Cleavage

Following completion of the peptide assembly, the peptide was cleaved from the resin by treatment with cleavage reagent, such as reagent K (82.5% trigluoroacetic acid, 5% water, 5% thioanisole, 5% phenol, 2.5% 1,2-ethanedithiol). The cleavage reagent was able to successfully cleave the peptide from the resin, as well as all remaining side chain protecting groups.

The cleaved peptides were precipitated in cold diethyl ether followed by two washings with ethyl ether. The filtrate was poured off and a second aliquot of cold ether was added, and the procedure repeated. The crude peptide was dissolved in a solution of acetonitrile:water (7:3 with 1% TFA) and filtered. The quality of linear peptide was verified using electrospray ionization mass spectrometry (ESI-MS) (Micromass/Waters ZQ) before being purified.

Disulfide Bond Formation via Oxidation

The peptide containing the free thiol (for example diPen) was assembled on a Rink Amide-MBHA resin following general Fmoc-SPPS procedure. The peptide was cleaved from the resin by treatment with cleavage reagent 90% trifluoroacetic acid, 5% water, 2.5% 1,2-ethanedithiol, 2.5% tri-isopropylsilane). The cleaved peptides were precipitated in cold diethyl ether followed by two washings with ethyl ether. The filtrate was poured off and a second aliquot of cold ether was added, and the procedure repeated. The crude peptide was dissolved in a solution of acetonitrile:water (7:3 with 1% TFA) and filtered giving the wanted unoxidized peptide crude peptide.

The crude, cleaved peptide with psoitions X4 and X9, for example, possessing either Cys, Pen, hCys, (D)Pen, (D)Cys or (D)hCys, was dissolved in 20 ml of water: acetonitrile. Saturated Iodine in acetic acid was then added drop wise with stirring until yellow color persisted. The solution was stirred for 15 minutes, and the reaction was monitored with analytic HPLC and LCMS. When the reaction was completed, solid ascorbic acid was added until the solution became clear. The solvent mixture was then purified by first being diluted with water and then loaded onto a reverse phase HPLC machine (Luna C18 support, 10u, 100A, Mobile phase A: water containing 0.1% TFA, mobile phase B: Acetonitrile (ACN) containing 0.1% TFA, gradient began with 5% B, and changed to 50% B over 60 minutes at a flow rate of 15 ml/min). Fractions containing pure product were then freeze-dried on a lyophilyzer.

Purification

Analytical reverse-phase, high performance liquid chromatography (HPLC) was performed on a Gemini C18 column (4.6 mm×250 mm) (Phenomenex). Semi-Preparative reverse phase HPLC was performed on a Gemini 10 m C18 column (22 mm×250 mm) (Phenomenex) or Jupiter 10 m, 300 angstrom (A) C18 column (21.2 mm×250 mm) (Phenomenex). Separations were achieved using linear gradients of buffer B in A (Mobile phase A: water containing 0.15% TFA, mobile phase B: Acetonitrile (ACN) containing 0.1% TFA), at a flow rate of 1 mL/min (analytical) and 15 mL/min (preparative). Separations were achieved using linear gradients of buffer B in A (Mobile phase A: water containing 0.15% TFA, mobile phase B: Acetonitrile (ACN) containing 0.1% TFA), at a flow rate of 1 mL/min (analytical) and 15 mL/min (preparative).

General Procedure 1A:

IL-23R inhibitor compounds described herein were synthesized from amino acids monomers using standard Fmoc solid phase synthesis techniques on a CEM Liberty Blue™ microwave peptide synthesizer. The peptides were assembled using Oxyma/DIC (ethyl cyanohydroxyiminoacetate/diisopropyl-carbodiimide) with microwave heating. Rink Amide-MBHA resin (100-200 mesh, 0.66 mmol/g) was used for peptides with C-terminal amides and preloaded Wang Resin with N-α-Fmoc protected amino acid was used for peptide with C-terminal acids. Oxyma was prepared as a 1M solution in DMF with 0.1M DIEA. DIC was prepared as 0.5M solution in DMF. The Amino acids were prepared at 200 mM. Peptide inhibitors of the present invention were identified based on medicinal chemistry optimization and/or phage display and screened to identify those having superior binding and/or inhibitory properties.

Assembly

The peptides were made using standard CEM Liberty Blue™ protocols. The peptide sequences were assembled as follows: Resin (400 mg, 0.25 mmol) was suspended in 10 ml of 50/50 DMF/DCM. The resin was then transferred to the reaction vessel in the microwave cavity. The peptide was assembled using repeated Fmoc deprotection and Oxyma/DIC coupling cycles. For deprotection, 20% 4-methylpiperidine in DMF was added to the reaction vessel and heated to 90° C. for 65 seconds. The deprotection solution was drained and the resin washed three times with DMF. For most amino acids, 5 equivalents of amino acid, Oxyma and DIC were then added to the reaction vessel and microwave irradiation rapidly heated the mixing reaction to 90° C. for 4 min. For Arginine and Histidine residues, milder conditions using respective temperatures of 75 and 50° C. for 10 min were used to prevent racemization. Rare and expensive amino acids were often coupled manually overnight at room temperature using only 1.5-2 eq of reagents. Difficult couplings were often double coupled 2×4 min at 90° C. After coupling the resin was washed with DMF and the whole cycle was repeated until the desired peptide assembly was completed.

Cleavage

Following completion of the peptide assembly, the peptide was then cleaved from the resin by treatment with a standard cleavage cocktail of 91:5:2:2 TFA/H2O/TIPS/DODT for 2 hrs. If more than one Arg(pbf) residue was present the cleavage was allowed to go for an additional hour.

The cleaved peptides were precipitated in cold diethyl ether. The filtrate was decanted off and a second aliquot of cold ether was added, and the procedure was repeated. The quality of linear peptide was then verified using electrospray ionization mass spectrometry (ESI-MS) (Waters®Micromass® ZQ™) before being purified.

Disulfide Bond Formation via Oxidation

The peptide containing the free thiol (for example diPen) was assembled on a Rink Amide-MBHA resin following general Fmoc solid phase synthesis, cleavage and isolation as described above.

The crude cleaved peptide comprising two thiol containing amino acids selected independently from Cys, Pen, hCys, (D)Pen, (D)Cys and (D)hCys was dissolved −2 mg/ml in 50/50 acetonitrile/water. Saturated iodine in acetic acid was then added dropwise with stirring until yellow color persisted. The solution was stirred for a few minutes, and the reaction was monitored with analytic HPLC and LCMS. When the reaction was completed, solid ascorbic acid was added until the solution became clear. The solvent mixture was then purified by first being diluted with water and then loaded onto a reverse phase HPLC Column (Luna® C18 support, 10u, 100A, Mobile phase A: water containing 0.1% TFA, mobile phase B: acetonitrile (ACN) containing 0.1% TFA, gradient began with 15% B, and changed to 50% B over 60 minutes at a flow rate of 15 ml/min). Fractions containing pure product were then freeze-dried on a lyophilizer.

Purification

Analytical reverse-phase, high performance liquid chromatography (HPLC) was performed on a Gemini® C18 column (4.6 mm×250 mm) (Phenomenex). Semi-Preparative reverse phase HPLC was performed on a Gemini® 10 m C18 column (22 mm×250 mm) (Phenomenex) or Jupiter® 10 m, 300 angstrom (A) C18 column (21.2 mm×250 mm) (Phenomenex). Separations were achieved using linear gradients of buffer B in A (Mobile phase A: water containing 0.15% TFA, mobile phase B: Acetonitrile (ACN) containing 0.1% TFA), at a flow rate of 1 mL/min (analytical) and 20 mL/min (preparative).

Example 1. Preparation of Peptide of SEO ID NO.:1

Ac-[Pen]*-N-T-[W(7-Me)]-[Lys(Ac)]-[Pen]*-Phe[4-(2-aminoethoxy)]-[2-Nal]-[THP]-E-N-[3-Pal]-Sarc-$NH_2$ (*Pen-Pen form disulfide bond) (SEQ ID NO.: 1)

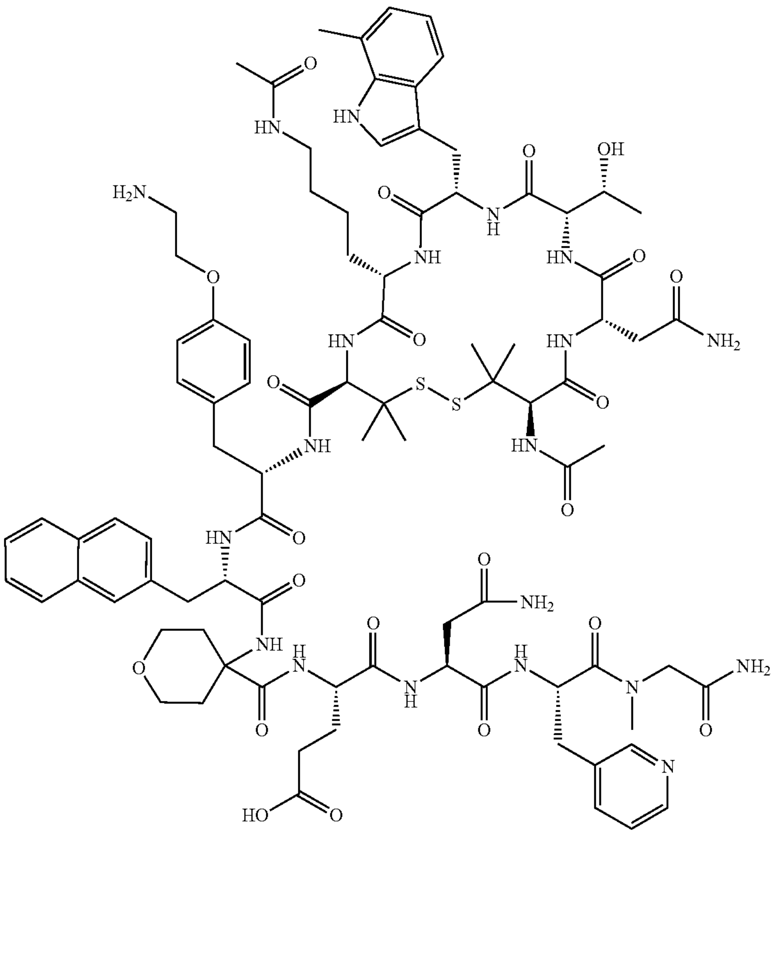 [SMILES: CC(=O)NCCCC[C@@H]1NC(=O)[C@H](Cc2c[nH]c3c(C)cccc23)NC(=O)[C@H]([C@@H](C)O)NC(=O)[C@H](CC(N)=O)NC(=O)[C@@H](NC(C)=O)C(C)(C)SSC(C)(C)[C@@H](C(=O)N[C@@H](Cc2ccc(OCCN)cc2)C(=O)N[C@@H](Cc2ccc3ccccc3c2)C(=O)NC2(C(=O)N[C@@H](CCC(=O)O)C(=O)N[C@@H](CC(N)=O)C(=O)N[C@@H](Cc3cccnc3)C(=O)N(C)CC(N)=O)CCOCC2)NC1=O]

The synthesis of SEQ ID NO.:1 is prepared using FMOC solid phase peptide synthesis techniques.

The peptide is constructed on Rink Amide MBHA resin using standard FMOC protection synthesis conditions reported in the literature. The constructed peptide is isolated from the resin and protecting groups by cleavage with strong acid followed by precipitation. Oxidation to form the disulfide bond is performed followed by purification by reverse phase HPLC (RP-HPLC) and counterion exchange. Lyophilization of pure fractions gives the final product.

Swell Resin: 10 g of Rink Amide MBHA solid phase resin (0.66 mmol/g loading) is transferred to a 250 ml peptide vessel with filter frit, ground glass joint and vacuum side arm. The resin is washed 3× with DMF.

Step 1: Coupling of FMOC-Sarc-OH: Deprotection of the resin bound FMOC group is realized by adding 2 resin-bed volumes of 20% 4-methyl-piperidine in DMF to the swollen resin and shaking for 3-5 min prior to draining and adding a second, 2-resin-bed volume of the 4-methyl piperidine solution and shaking for an additional 20-30 min. After deprotection the resin is washed 3× DMF with shaking. FMOC-Sarc-OH (3 eq, 6.2 g) is dissolved in 100 ml DMF along with Oxyma (4.5 eq, 4.22 g). Preactivation of the acid is accomplished by addition of DIC (3.9 eq, 4 ml) with shaking for 15 min prior to addition to the deprotected resin. An additional aliquot of DIC (2.6 eq, 2.65 ml) is then added after ~15 min of coupling. The progress of the coupling reaction is monitored by the colorimetric Kaiser test. Once the reaction is judged complete the resin is washed 3× DMF with shaking prior to starting the next deprotection/coupling cycle.

Step 2: Coupling of FMOC-3Pal-OH: FMOC deprotection is again accomplished by adding two sequential, 2-resin-bed volumes of 20% 4-methyl-piperidine in DMF, one times 3-5 minutes, and one times 20-30 minutes, draining in between treatments. The resin is then washed 3 times prior to coupling with protected 3-pyridyl alanine (3Pal). FMOC-3Pal-OH (3 eq, 7.8 g) is dissolved in DMF along with Oxyma (4.5eq, 4.22 g). Preactivation with DIC (3.9 eq, 4 ml) for 15 minutes is done prior to addition to the Sarc-Amide resin. After 15 minutes, an additional aliquot of DIC (2.6 eq, 2.65 ml) is added to the reaction. Once the reaction is complete as determined by the Kaiser test, the resin is again washed 3× with DMF prior to starting the next deprotection/coupling cycle.

Step 3: Coupling of FMOC-Asn(Trt)-OH: The FMOC is removed from the N-terminus of the resin bound 3Pal and washed as previously described. FMOC-Asn(Trt)-OH (2eq, 8 g) is dissolved in 100 ml of DMF along with Oxyma (3eq, 2.81 g). DIC (2.6 eq, 2.65 ml) is added for preactivation of the acid for ~15 minutes prior to addition to the 3Pal-Sarc-Amide resin. After −15 minutes, an additional aliquot of DIC (1.4 eq, 1.43 ml) is added to the reaction. Once the reaction is complete as determined by the Kaiser test, the resin is washed 3× with DMF prior to starting the next deprotection/coupling cycle.

Step 4: Coupling of FMOC-Glu(OtBu)—OH: The FMOC is removed from the N-terminus of the resin bound Asparagine and the resin washed with DMF as previously described. FMOC-Glu(OtBu)—OH (2 eq, 5.91 g) is dissolved in 100 ml of DMF along with Oxyma (3eq, 2.81 g). DIC (2.6 eq, 2.65 ml) is added for preactivation of the acid −15 minutes prior to addition to the Asn(Trt)-3Pal-Sarc-Amide resin. After −15 minutes, an additional aliquot of DIC (1.4 eq, 1.43 ml) is added to the reaction. Once the reaction is complete as determined by the Kaiser test the resin is washed 3× with DMF prior to starting the next deprotection/coupling cycle.

Step 5: Coupling of FMOC-THP-OH: The FMOC is removed from the N-terminus of the resin bound peptide and the resin is washed as previously described. FMOC-THP-OH (3 eq, 7.36 g) is dissolved in 100 ml of DMF along with Oxyma (4.5 eq, 4.22 g). DIC (3.9 eq, 4 ml) is added for preactivation of the acid ~15 minutes prior to addition to the Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test the resin is washed 3× with DMF prior to starting the next deprotection/coupling cycle.

Step 6: Coupling of FMOC-L-Ala(2—Naphthyl)-OH (Nal): The FMOC is removed from the N-terminus of the resin bound peptide and the resin washed as previously described. FMOC-L-Ala(2—Naphthyl)-OH (3 eq, 8.66 g) is dissolved in 100 ml of DMF along with Oxyma (4.5 eq, 4.22 g). DIC (3.9 eq, 4 ml) is added for preactivation of the acid ~15 minutes prior to addition to the THP-Glu(OtBu)-Asn (Trt)-3Pal-Sarc-Amide resin. After ~15 minutes, an additional aliquot of DIC (2.6 eq, 2.65 ml) is added. Once the reaction is complete as determined by the Kaiser test the resin was again washed 3× with DMF prior to starting the next deprotection/coupling cycle.

Step 7: Coupling of FMOC-4-[2-(Boc-amino-ethoxy)]-L-Phenylalanine (FMOC-AEF): The FMOC is removed from the N-terminus of the resin bound peptide and the resin washed as previously described. FMOC-4-[2-(Boc-amino-ethoxy)]-L-Phenylalanine (3 eq, 10.8 g) is dissolved in 100 ml of DMF along with Oxyma (4.5 eq, 4.22 g). DIC (3.9 eq, 4 ml) is added for preactivation of the acid ~15 minutes prior to addition to the Nal-THP-Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test the resin is washed 3× with DMF prior to starting the next deprotection/coupling cycle.

Step 8: Coupling of FMOC-Pen(Trt)-OH: The FMOC is removed from the N-terminus of the resin bound peptide and the resin washed as previously described. FMOC-Pen(Trt)-OH (3 eq, 12.14 g) is dissolved in 100 ml of DMF along with Oxyma (4.5 eq, 4.22 g). DIC (3.9 eq, 4 ml) is added for preactivation of the acid ~15 minutes prior to addition to the AEF-Nal-THP-Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test, the resin is again washed 3× with DMF prior to starting the next deprotection/coupling cycle.

Step 9: Coupling of FMOC-Lys(Ac)-OH: The FMOC is removed from the N-terminus of the resin bound peptide and the resin washed as previously described. FMOC-Lys(Ac)-OH (2 eq, 5.4 g) is dissolved in 100 ml of DMF along with Oxyma (3 eq, 2.81 g). DIC (2.6 eq, 2.65 ml) is added for preactivation of the acid ~15 minutes prior to addition to the Pen(Trt)-AEF-Nal-THP-Glu(OtBu)-Asn(Trt)-3Pal-Sarc-Amide resin. After ~15 minutes, an additional aliquot of DIC (1.4 eq, 1.43 ml) is added to the reaction. Once the reaction was complete as determined by the Kaiser test, the resin is again washed 3× with DMF prior to starting the next deprotection/coupling cycle.

Step 10: Coupling of FMOC-7-Me-Trp-OH: The FMOC is removed from the N-terminus of the resin bound peptide and the resin washed as previously described. FMOC-7-Me-Trp-OH (2 eq, 5.81 g) is dissolved in 100 ml of DMF along with Oxyma (3 eq, 2.81 g). DIC (2.6 eq, 2.65 ml) is added for preactivation of the acid ~15 minutes prior to addition to the Lys(Ac)-Pen(Trt)-AEF-Nal-THP-Glu(OtBu)-Asn(Trt)-3Pal-Sarc-Amide resin. After ~15 minutes, an additional aliquot of DIC (1.4 eq, 1.43 ml) is added to the reaction. Once the reaction is complete as determined by the Kaiser test, the resin is again washed 3× with DMF prior to starting the next deprotection/coupling cycle.

Step 11: Coupling of FMOC-Thr(tBu)—OH: The FMOC is removed from the N-terminus of the resin bound peptide and the resin washed as previously described. FMOC-Thr(tBu)—OH (4 eq, 10.5 g) is dissolved in 100 ml of DMF along with Oxyma (6 eq, 5.62 g). DIC (5.2 eq, 5.3 ml) is added for preactivation of the acid ~15 minutes prior to addition to the 7MeTrp-Lys(Ac)-Pen(Trt)-AEF-Nal-THP-Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test, the resin is again washed 3× with DMF prior to starting the next deprotection/coupling cycle.

Step 12: Coupling of FMOC-Asn(Trt)-OH: The FMOC is removed from the N-terminus of the resin bound peptide and the resin washed as previously described. FMOC-Asn(Trt)-OH (4 eq, 15.8 g) is dissolved in 100 ml of DMF along with Oxyma (6 eq, 5.62 g). DIC (5.2 eq, 5.3 ml) is added for preactivation of the acid ~15 minutes prior to addition to the Thr(tBu)-7MeTrp-Lys(Ac)-Pen(Trt)-AEF-Nal-THP-Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test, the resin is again washed 3× with DMF prior to starting the next deprotection/coupling cycle.

Step 13: Coupling of FMOC-Pen(Trt)-OH: The FMOC is removed from the N-terminus of the resin bound peptide and the resin washed as previously described. FMOC-Pen(Trt)-OH (2 eq, 8.1 g) is dissolved in 100 ml of DMF along with Oxyma (3 eq, 2.81 g). DIC (2.6 eq, 2.65 ml) is added for preactivation of the acid ~15 minutes prior to addition to the Asn(Trt)-Thr(tBu)-7MeTrp-Lys(Ac)-Pen(Trt)-AEF-Nal-THP-Glu(OtBu)-Asn(Trt)-3Pal-Sarc-Amide resin. After ~15 minutes, an additional aliquot of DIC (2.6 eq, 2.65 ml) is added to the reaction. Once the reaction is complete as determined by the Kaiser test, the resin is again washed 3× with DMF prior to the final deprotection and acetic acid capping of the constructed peptide.

Step 14: Acetyl Capping: The FMOC is removed from the N-terminus of the resin bound peptide and the resin washed as previously described. 150 ml of Capping Reagent A (THF/Acetic anhydride/Pyridine, 80:10:10) is added to the constructed Pen(Trt)-Asn(Trt)-Thr(tBu)-7MeTrp-Lys(Ac)-Pen(Trt)-AEF-Nal-THP-Glu(OtBu)-Asn(Trt)-3Pal-Sarc-Amide resin and shaken for 30 min. The resin is washed 3× with DMF followed by 5× with DCM. The resin is divided into 5-50 ml centrifuge tubes and placed under vacuum for 1.5 hrs prior to cleavage with TFA.

Step 15: TFA Cleavage and Ether precipitation: 200 ml of the TFA cleavage cocktail (90/5/2.5/2.5 TFA/water/TIPS/DODT) is prepared. 40 ml of the cleavage cocktail is added to each of the 5 tubes containing the protected resin bound peptide and shaken for two hours. The spent resin is filtered away and the filtrate divided evenly into 18-50 ml centrifuge tubes for precipitation. Cold diethyl ether is added to each forming a white precipitate that is then centrifuged. The ether is decanted to waste and 2 more ether washes of the precipitate are performed. The resulting white precipitate cake is dried overnight in the hood to give the crude reduced peptide.

Step 16: Disulfide Oxidation: The crude peptide is oxidized and purified in four 1L batches.~2.5 g of crude peptide is dissolved in 1L 20% ACN/water. With stirring, a saturated solution of iodine in acetic acid/methanol is added dropwise to the 1L peptide solution until the yellow/brown color of the $I_2$ remains and does not fade away. The light-yellow solution is allowed to sit for 5 min prior to quenching the excess $I_2$ with a pinch of ascorbic acid.

Step 17: RP-HPLC purification: The RP-HPLC purification is performed s immediately following each $I_2$ oxidation. A preparative purification column (Phenomenex, Luna, C18 (2), 100A, 250×50 mm) is equilibrated at 70 ml/min with 20% MPB in MPA (MPA=0.1% TFA/water, MPB=0.1% TFA in ACN). The 1 L of quenched oxidized peptide is loaded onto the equilibrated column at 70 ml/min. After the solvent front elutes, a gradient of 25-45% MPB at 70 ml/min is run over 60 min. The desired material is isolated in fractions, and each are analyzed by analytical RP-HPLC. Pure fractions are combined from all four purifications and lyophilized to give purified TFA salt ready for counterion exchange.

Step 18: Counterion Exchange to Acetate: The same preparative RP-HPLC column is equilibrated with 5% MPB in MPA at 70 ml/min (MPA=0.3% AcOH in Water, MPB=0.3% AcOH in ACN, MPC=0.5M $NH_40Ac$ in Water.) The purified peptide TFA salt is dissolved in 50/50 ACN/water and diluted to 15% ACN. The solution is loaded onto the equilibrated column at 70 ml/min and the solvent front is eluted. The captured peptide is washed with 5% MPB in MPA for 5 min. The captured peptide is then washed with 5% MPB in MPC for 40 min at 70 ml/min to exchange the counterions to Acetate. The captured peptide is washed with 5% MPB in MPA at 70 ml/min for 10 min to clear all $NH_40Ac$ from the system. Finally, the peptide is eluted with a gradient of 5-70% MPB in MPA over 60 minutes and collected in fractions.

Step 19: Final Lyophilization and Analysis: The collected fractions are analyzed by analytical RP-HPLC, and all fractions >95% purity are combined. Lyophilization of the combined fractions gives SEQ ID NO.:1 as a white powder with a purity >95% as determined by RP-HPLC. Peptide identity is confirmed with LC/MS of the purified Peptide of SEQ ID NO.:1, giving 2 charged states of the peptide, M+2/2 of 950 amu and the molecular ion of 1899 amu.

Example 2. Synthesis of MeCO-r-Pen*-N-T-7MeW-K(Ac)-Pen*-AEF-2Nal-THP-E-N-3Pva-Sar-K (PEG2PEG2gEC180H)-CONH2 (*Pen-Pen form disulfide bond)

Intermediate 2-1

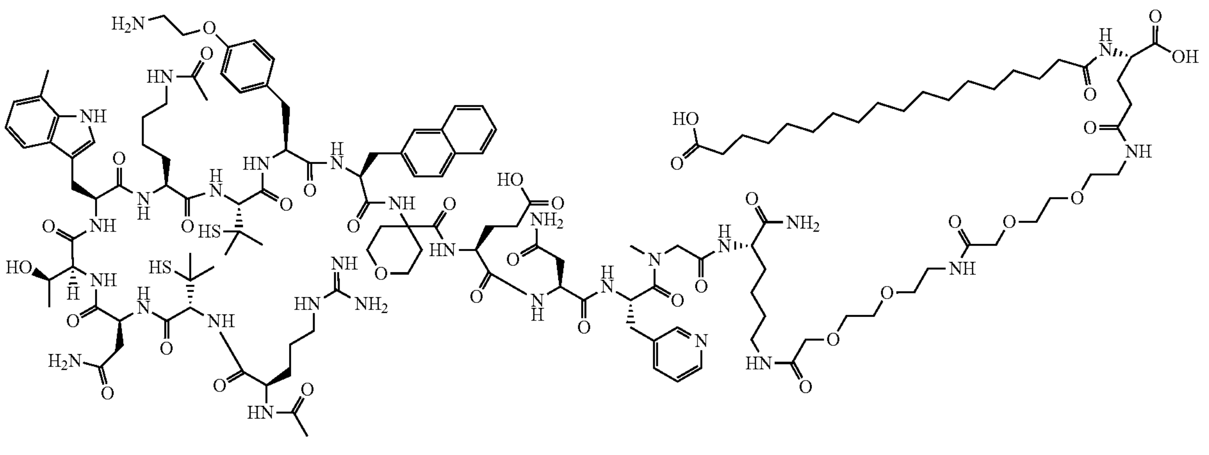

Synthesis of Intermediate 2-1

Intermediate 2-1 was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr and Glu; trityl for Pen and Asn; tert-butoxy-carbonyl for AEF, Pbf (2,2,4,6,7-pentamethyldihydrobenzofuran-5-sulfonyl) for Arg. The C-terminal Lys was protected by the orthogonal DDe protecting group.

All the amino acids were dissolved at a 0.4 M concentration in DMF. The acylation reactions were performed for 3 min at 90° C. under microwave (MW) irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (3x5 mL). The deprotection step was repeated, and then the resin was washed with DCM (5x5 mL) and DMF (5x5 mL). Further side chain derivatization was performed on Cem Liberty Blue microwave peptide synthesizer using standard coupling conditions with 5 folds excess of activated building blocks (Fmoc-PEG2, Fmoc-PEG2 and the Fmoc-gE (Fmoc-Glu-OtBu) and equimolar amounts of 0.5M solution of DIC in DMF and Oxyma solution 1M in DMF. C180H (18-(tert-butoxy)-18-oxooctadecanoic acid) was coupled manually using DIC-HOAT (3Eq, 1:1:1) at room temperature and complete acylation was monitored by ninhydrin test.

At the end of the assembly the resin was washed with DMF, MeOH, DCM, and $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethylether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 2-1 (50% yield). LCMS anal. calc. for $C_137H_{207}N2_9036S2$:2900.45; found: 967.8 $(M+3)^3$.

Synthesis of MeCO-r-Pen*-N-T-7MeW-K(Ac)-Pen*-AEF-2Nal-THP-E-N-3Pya-Sar-K (PEG2PEG2gEC180H)-$CONH_2$ (*Pen-Pen form disulfide bond)

Intermediate 2-1 was dissolved in ACN/$H_2O$ (1 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (5% yield). LCMS anal. calc. for $C_{137}H_{205}N_{29}O_{36}S_2$: 2898.4; found; 1450.0 $(M+2)^{2+}$.

Example 3. Synthesis of MeCO-r-Pen*-N-T-7MeW-K(Ac)-Pen*-AEF-2Nal-THP-E-N-3Pva-NMeK (PEG2PEG2gEC180H)-CONH2 (*Pen-Pen form disulfide bond)

(tert-butoxy)-18-oxooctadecanoic acid) was coupled using DIC-HOAT (3Eq, 1:1:1) at room temperature and complete acylation was monitored by ninhydrin test.

At the end of the assembly the resin was washed with DMF, MeOH, DCM, $Et_2O$. The peptide was cleaved from Intermediate 3-1

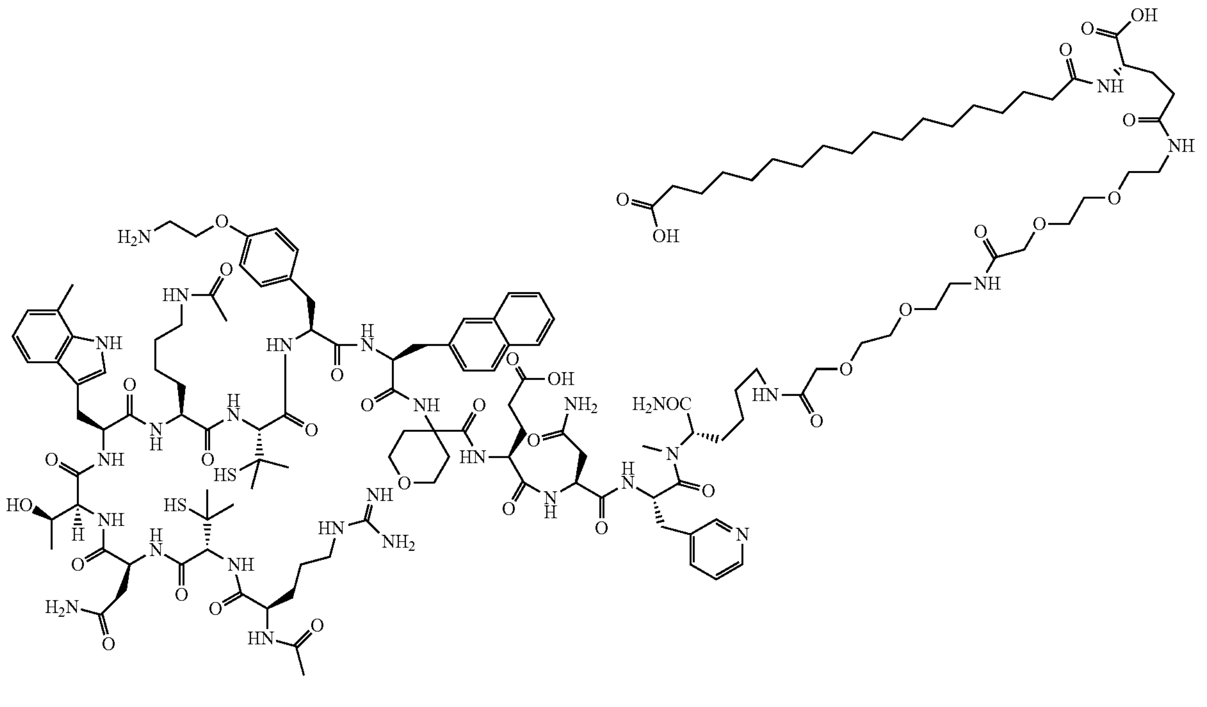

Synthesis of Intermediate 3-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr and Glu; trityl for Pen and Asn; tert-butoxy-carbonyl for AEF, Pbf (2,2,4,6,7-pentamethyldihydrobenzofuran-5-sulfonyl) for Arg. The C-terminal NMeLys was protected by the orthogonal DDe protecting group. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF.

Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (3x5 mL). The deprotection step was repeated, and then the resin was washed with DCM (5x5 mL), DMF (5x5 mL). Further side chain derivatization was performed manually (PEG2, PEG2 and the gE (Fmoc-Glu-OtBu) residues) using DIC-HOAT (3Eq, 1:1:1) at room temperature. C180H (18-solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 3-1 (59.2% yield). LCMS anal. calc. For $C_{135}H_{204}N_{28}O_{35}S_2$: 2843.38; found: 948.8 $(M+3)^{3+}$.

Synthesis of MeCO-r-Pen*-N-T-7MeW-K(Ac)-Pen*-AEF-2Nal-THP-E-N-3Pya-NMeK (PEG2PEG2gEC180H)-$CONH_2$ (*Pen-Pen form disulfide bond)

Intermediate 3-1 was dissolved in $ACN/H_2O$ (5 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (11% yield). LCMS anal. calc. For $C_{135}H_{202}N_{28}O_{35}S_2$: 2841.38; found: 1421.7 $(M+2)^{2+}$.

Example 4. Synthesis of MeCO-Pen*-N-T-7MeW-K(Ac)-Pen*-AEF-2Nal-THP-K (PEG2PEG2gEC180H)-N-3Pva-Sar-CONH2 (*Pen-Pen form disulfide bond)

Intermediate 4-1

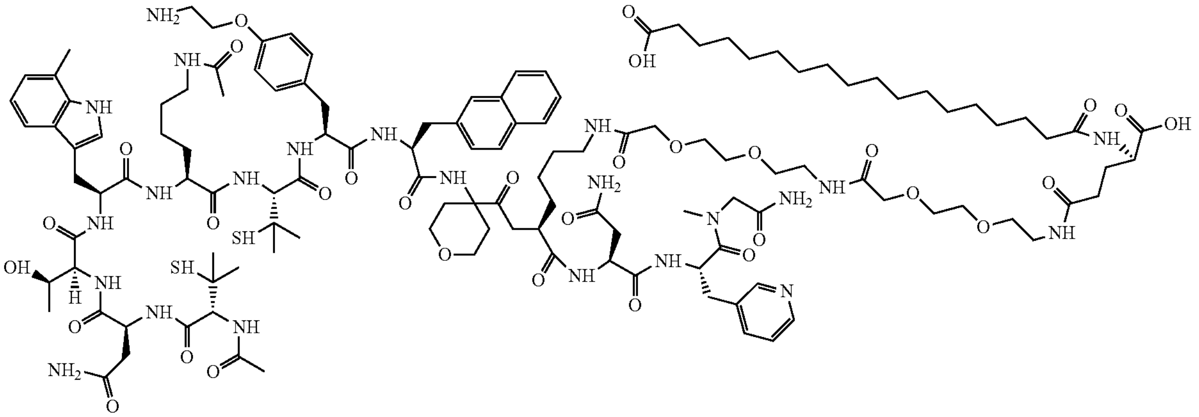

Synthesis of Intermediate 4-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; tert-butoxy-carbonyl for AEF. The Lys to be lipidated was protected by the orthogonal DDe protecting group.

All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (3x5 mL). The deprotection step was repeated, and then the resin was washed with DCM (5x5 mL), DMF (5x5 mL). Further side chain derivatization was performed manually (PEG2, PEG2 and the gE (Fmoc-Glu-OtBu) residues) using DIC-HOAT (3Eq, 1:1:1) at room temperature. C180H (18-(tert-butoxy)-18-oxooctadecanoic acid) was coupled using DIC-HOAT (6Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 4-1 (70% yield). LCMS anal. calc $C_{126}H_{188}N_{24}O_{32}S_2$: 2615.13; found: 1308.5 $(M+2)^{2+}$.

Synthesis of MeCO-Pen*-N-T-7MeW-K(Ac)-Pen*AEF-2Nal-THP-K(PEG2PEG2,gEC180H)-N—3Pya-Sar-$CONH_2$ (*Pen-Pen form disulfide bond)

Intermediate 4-1 was dissolved in ACN/$H_2O$ (1 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 45% B over 25 min, flow rate 80 mL/min, wavelength 214 nm.

Collected fractions were lyophilized to afford the desired compound (24% yield): LCMS anal. calc. For $C_{126}H_{186}N_{24}O_{32}S_2$: 2613.13; found: 1307.4$(M+2)^{2+}$.

Example 5. Synthesis of MeCO-k (PEG2PEG2gEC180H)-Pen*-N-T-7MeW-K(Ac)-Pen*-AEF-2Nal-THP-K(Ac)-N-3Pva-Sar-CONH2 (*Pen-Pen form disulfide bond)

Intermediate 5-1

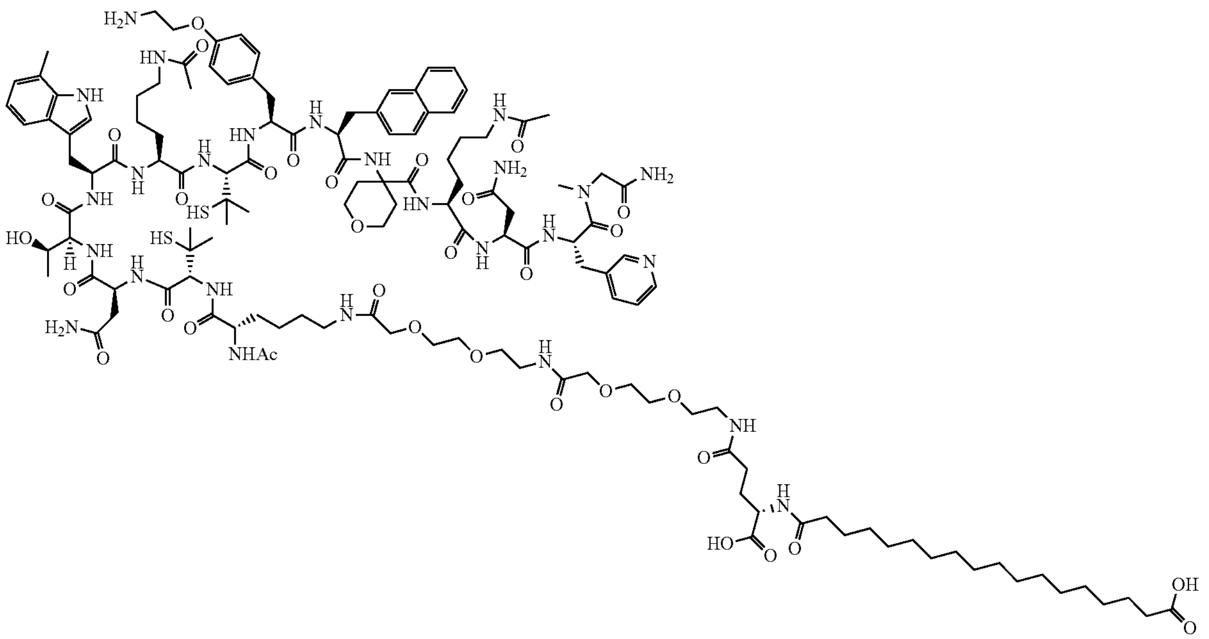

Synthesis of Intermediate 5-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; tert-butoxy-carbonyl for AEF. The N-terminal D-Lys was protected by the orthogonal DDe protecting group.

All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (3×5 mL). The deprotection step was repeated, and then the resin was washed with DCM (5×5 mL), DMF (5×5 mL). Further side chain derivatization was performed manually (PEG2, PEG2 and the gE (Fmoc-Glu-OtBu) residues) using DIC-HOAT (3Eq, 1:1:1) at room temperature. C18OH (18-(tert-butoxy)-18-oxooctadecanoic acid) was coupled using DIC-HOAT (6Eq, 1:1:1) at room temperature and complete acylation was monitored by ninhydrin test.

At the end of the assembly the resin was washed with DMF, MeOH, DCM, and $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethylether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 5-1 (89% yield). LCMS anal. calc. For $C_{134}H_{202}N_{26}O_{34}S_2$: 2785.3; found: 1393.4 $(M+2)^{2+}$.

Synthesis of MeCO-k(PEG2PEG2gEC80H)-Pen*-N-T-7MeW-K(Ac)-Pen*-AEF-2Nal-THP—K(Ac)-N-3Pya-Sar-$CONH_2$ (*Pen-Pen form disulfide bond)

Intermediate 5-1 was dissolved in ACN/$H_2O$ (5 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford desired compound (28% yield): LCMS anal. calc. For $C_{134}H_{200}N_{26}O_{34}S_2$: 2783.34; found: 1392.4 $(M+2)^{2+}$.

Example 6. Synthesis of MeCO-r-Pen*-N-T-7MeW-K(Ac)-Pen*-AEF(PEG2PEG2gEC18OH)-2Nal-THP—K(Ac)-N-3Pva-Sar-CONH2 (*Pen-Pen form disulfide bond)

Intermediate 6-1

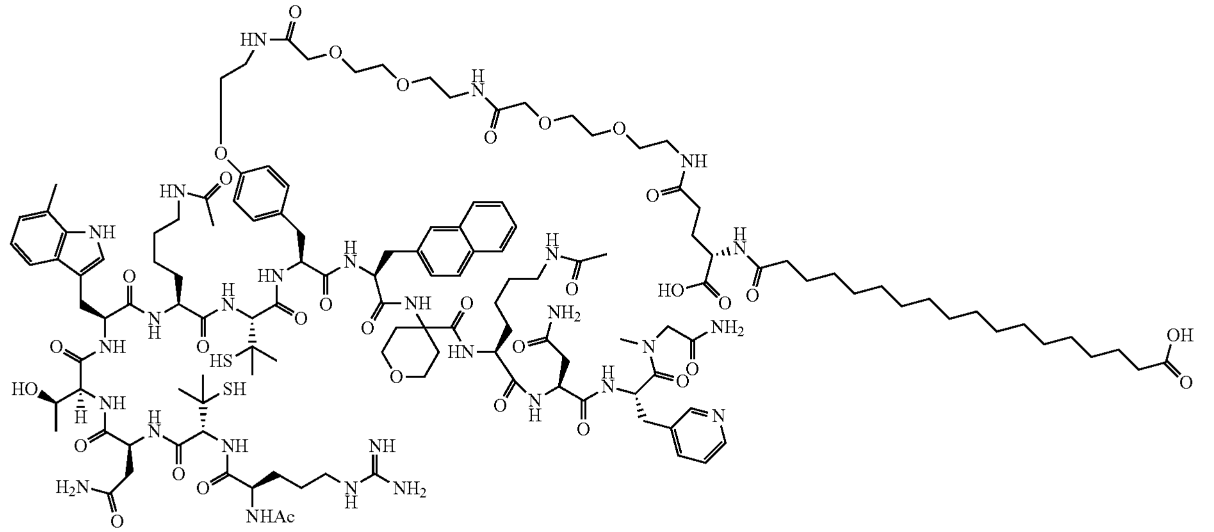

Synthesis of Intermediate 6-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; Pbf (2,2,4,6,7-pentamethyldihydrobenzofuran-5-sulfonyl) for Arg. The AEF was protected by the orthogonal DDe protecting group. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF.

At the end of the peptide assembly on solid phase, the resin was treated with 100 ml of 3% hydrazine solution in DMF. The solution was drained, and the resin washed with DCM (3x5 mL) and DMF (5x5 mL). Further side chain derivatization was performed manually (PEG2, PEG2 and the gE (Fmoc-Glu-OtBu) residues) using DIC-HOAT (3Eq, 1:1:1) at room temperature. C18OH (18-(tert-butoxy)-18-oxooctadecanoic acid) was coupled using DIC-HOAT (6Eq, 1:1:1) in NMP at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 6-1 (78.5% yield). LCMS anal. calc. For $C_{134}H_{202}N_{28}O_{34}S_2$: 2813.37; found: 938.5 $(M+3)^3$.

Synthesis of MeCO-r-Pen*-N-T-7MeW-K(Ac)-Pen*AEF(PEG2PEG2pEC18OH)-2Nal-THP—K(Ac)-N-3Pya-Sar-$CONH_2$ (*Pen-Pen form disulfide bond)

Intermediate 6-1 was dissolved in ACN/$H_2O$ (1 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (10% yield): LCMS anal. calc. For C134H200N28034S2:2811.36; found: 1406.2 $(M+2)^{2+}$.

Example 7. Synthesis of MeCO-k (PEG2PEG2SP6gEC18OH)-Pen*-N-T-7MeW-K (Ac)-Pen*-AEF-2Nal-THP—K(Ac)-N-3Pva-Sar-CONH2(*Pen-Pen form disulfide bond)

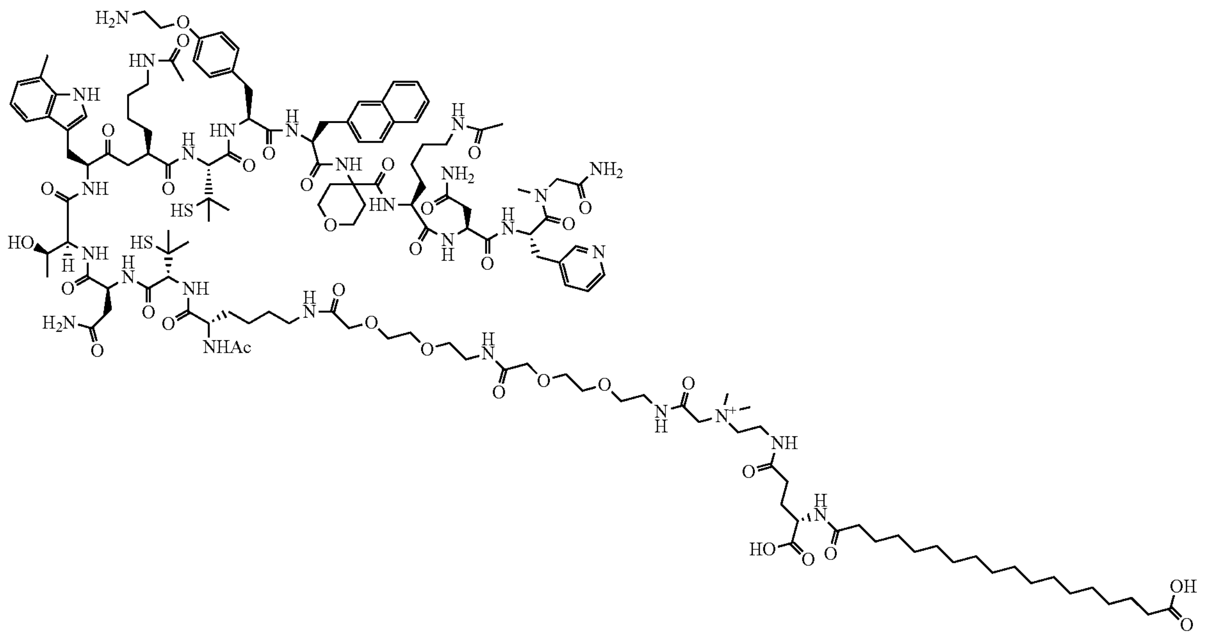 [SMILES: CC(=O)NCCCC[C@H](CC(=O)[C@H](Cc1c[nH]c2c(C)cccc12)NC(=O)[C@@H](NC(=O)[C@H](CC(N)=O)NC(=O)[C@@H](NC(=O)[C@H](CCCCNC(=O)COCCOCCNC(=O)COCCOCCNC(=O)C[N+](C)(C)CCNC(=O)CC[C@H](NC(=O)CCCCCCCCCCCCCCCCC(=O)O)C(=O)O)NC(C)=O)C(C)(C)S)[C@@H](C)O)C(=O)N[C@H](C(=O)N[C@@H](Cc1ccc(OCCN)cc1)C(=O)N[C@@H](Cc1ccc2ccccc2c1)C(=O)NC1(C(=O)N[C@@H](CCCCNC(C)=O)C(=O)N[C@@H](CC(N)=O)C(=O)N[C@@H](Cc2cccnc2)C(=O)N(C)CC(N)=O)CCOCC1)C(C)(C)S]

Synthesis of Intermediate 7-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.34 mmol/g) on the Cem Liberty Blue microwave peptide synthesizer (CEM Inc.). During peptide assembly on solid phase, the side chain protecting groups were: tert-butyl for Thr and Glu; trityl for Pen and Asn; tert-butoxy-carbonyl for AEF. The N-terminal D-Lys was protected by the orthogonal DDe protecting group.

All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF.

At the end of the peptide assembly on solid phase, the resin was treated with 100 ml of 3% hydrazine solution in DMF. The solution was drained, and the resin washed with DCM (3×5 mL) and DMF (5×5 mL). Further side chain derivatization was performed manually (PEG2, PEG2, Fmoc-SP6 ((2-((((9H-fluoren-9-yl)methoxy)carbonyl) amino)-N-(carboxymethyl)-N,N-dimethylethan-1-aminium) and the gE (Fmoc-Glu-OtBu) residues) using DIC-HOAT (3Eq, 1:1:1) at room temperature. C18OH (18-(tert-butoxy)-18-oxooctadecanoic acid) was coupled using DIC-HOAT (6Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 7-1 (80% yield). LCMS anal. calc. C140H215N28035S2+: 2914.52; found: 972.5 $(M+3)^{3+}$.

Synthesis of MeCO-k(PEG2PEG2SP6gEC18OH)-Pen*-N-T-7MeW-K(Ac)-Pen*-AEF-2Nal-THP—K (Ac)-N-3Pya-Sar-CONH2

Intermediate 7-1 was dissolved in ACN/$H_2O$ (1 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (35% yield). LCMS anal. calc. For $C_{140}H_{213}N_{28}O_{35}S_2$+: 2912.52; found: 1456.6$(M+2)^{2+}$.

Example 8. Synthesis of MeCO-Pen*-N-T-7MeW-K(Ac)-Pen*-AEF-2Nal-THP—K(Ac)-N— 3Pva-Sar-PEG2-PEG2-eK(C160H)-COOH (*Pen-Pen form disulfide bond)

end of the peptide assembly on solid phase, the resin was treated with 100 ml of 3% hydrazine solution in DMF. The solution was drained, and the resin washed with DCM (3×5 mL) and DMF (5×5 mL). Further side chain derivatization with C160H (hexadecandioic acid) was performed manually Intermediate 8-1

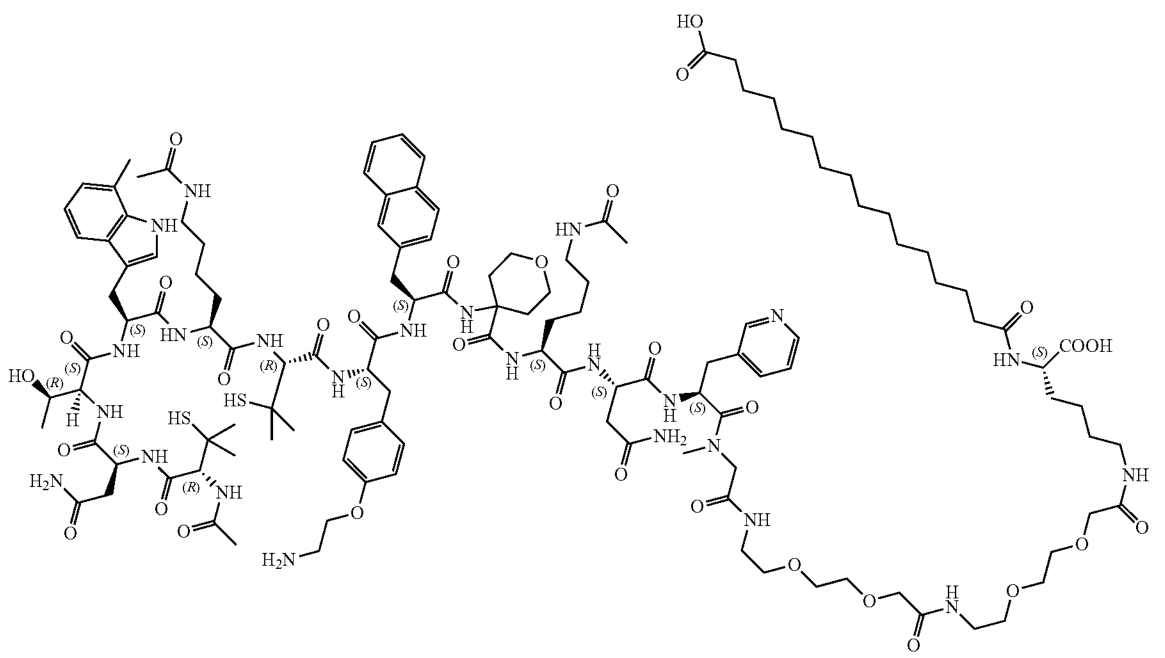

Synthesis of Intermediate 8-1

The peptide was synthesized by standard Solid-phase Peptide Synthesis (SPPS) using Fmoc/t-Bu chemistry. The assembly was performed on a Wang resin (75 mol, 100-200Mesh; loading 0.33 mmol/g). First amino acids were incorporated manually: Dde-Lys(Fmoc)—OH (10 eq) was dissolved in 7 ml of a solution of dry DCM/dry DMF (10:1) under $N_2$ and DIC (5 eq) was added at 0° C., Reaction mixture was left under stirring at 0° C. for 20 min, then concentrated to dryness. The residue was dissolved in dry DMF and added to Wang resin (Novabiochem, 100-200 mesh, 0.83 mmol/g), under $N_2$ atmosphere. DMAP (4-Dimethylaminopyridine, 0.1 eq) was added. The mixture was stirred at RT for 1 h, then the cycle was repeated. After Fmoc removal, assembly was continued on a CEM Liberty Blue microwave peptide synthesizer (CEM Inc.). During peptide synthesis on solid phase, the side chain protecting groups were: tert-butyl for Thr; trityl for Pen and Asn; tert-butoxycarbonyl for AEF. Lys source was N6-(((9H-fluoren-9-yl) methoxy)carbonyl)-N2-(1-(4,4-dimethyl-3,5-dioxocyclohexylidene)ethyl)-L-lysine. All the amino acids and building blocks were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5 M solution of DIC in DMF and Oxyma solution 1 M in DMF. Double acylation reactions were performed for 3Pya and 2Nal. Fmoc deprotections were performed using 20% (V/V) piperidine in DMF. Capping of the free amino group was performed manually using 10 equiv. of acetic anhydride in DMF. At the using DIC-HOAT (6Eq, 1:1:1) at room temperature and complete acylation was monitored by ninhydrin test.

At the end of the assembly, the resin was washed with NMP, DMF, MeOH, DCM, and $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 8-1 (60% yield). LCMS anal. calc. For $C_{127}H_{190}N_{24}O_{32}S_2$ 2629.16; found: 1315.7 $(M+2)^{2+}$.

Synthesis of MeCO-Pen*-N-T-7MeW-K(Ac)-Pen*-AEF-2Nal-THP—K(Ac)-N-3Pya-Sar-PEG2-PEG2-eK(C160H)-COOH Intermediate 8-1 was dissolved in ACN/$H_2O$ (5 mg/ml). Saturated iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Reprosyl C4 (200×40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 60 mL/min, wavelength 214 nm. Collected fractions were lyophilized to afford the desired compound (7% yield): LCMS anal. calc. For $C_{127}H_{188}N_{24}O_{32}S_2$ 2627.16; found: 1314.7 $(M+2)^{2+}$.

Example 9. Synthesis of MeCO-k (PEG2PEG22EmXOH)-Pen*-N-T-7MeW-K(Ac)-Pen*-AEF-2Nal-THP-K(PEG2PEG2gEmXOH)-N-3Pva-Sar-CONH2(*Pen-Pen form disulfide bond)

decanoic acid) was coupled using DIC-HOAT (4Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and Intermediate 9-1

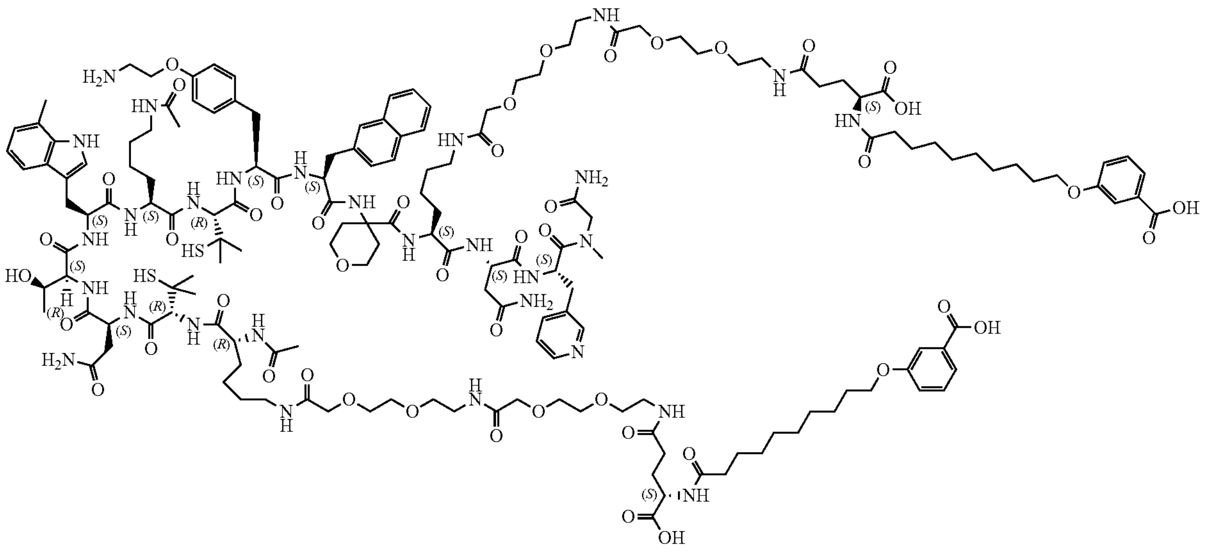

Synthesis of Intermediate 9-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; tert-butoxy-carbonyl for AEF. The Lys to be attached to the THP and the N-terminal D-Lys were protected by the orthogonal DDe protecting group.

All the amino acids were dissolved at a 0.4 M concentration in DMF. The acylation reactions were performed for 3 min at 90° C. under microwave (MW) irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF to remove the DDe protecting group from Lys/D-Lys. The solution was drained, and the resin washed with DCM (3x5 mL). The deprotection step was repeated, and then the resin was washed with DCM (5x5 mL), DMF (5x5 mL). Further side chain derivatization was performed manually (PEG2, PEG2 and the gE (Fmoc-Glu-OtBu) residues) using DIC-HOAT (6Eq, 1:1:1) at room temperature. mXOH (10-(3-(tert-butoxycarbonyl)phenoxy)

precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 9-1 (70% yield). LCMS anal. calc. For $C_{165}H_{241}N_{29}O_{47}S_2$ 3447; found: 1150 $(M+2)^{2+}$.

Synthesis of MeCO-k(PEG2PEG2gEmXOH)-Pen*-N-T-7MeW-K(Ac)-Pen*-AEF-2Nal-THP-K(PEG2PEG2gEmXOH)-N-3Pya-Sar-$CONH_2$ Intermediate 9-1 was dissolved in $ACN/H_2O$ (1 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (13% yield): LCMS anal. calc. For $C_{165}H_{239}N_{29}O_{47}S_2$ 3445; found: 1149.1 $(M+3)^{3+}$.

Example 10. Synthesis of MeCO-k (PEG2PEG22EC160H)-Pen*-N-T-7MeW-K(Ac)-Pen*-AEF-2Nal-THP-K(gEC16)-N-3Pva-Sar-CONH2(*Pen-Pen form disulfide bond)

Intermediate 10-1

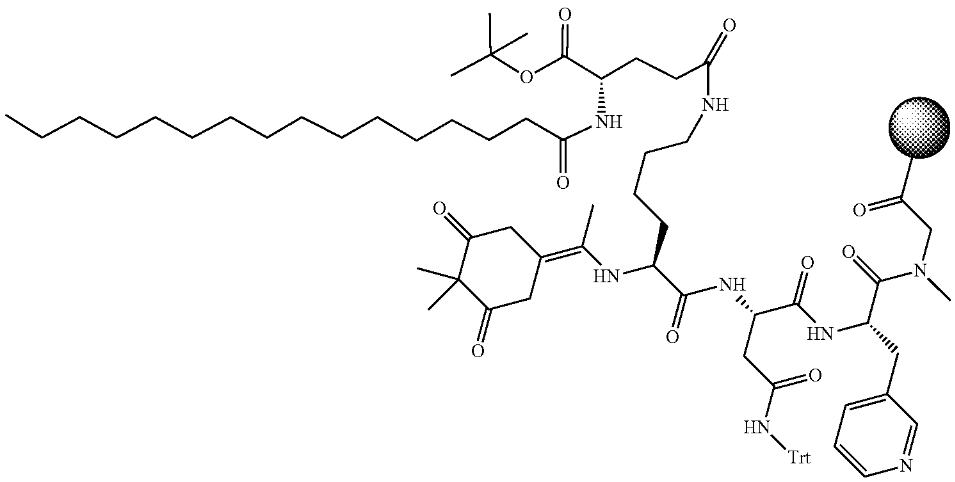

Synthesis of Intermediate 10-1

The peptide was synthesized by standard Solid-phase Peptide Synthesis (SPPS) using Fmoc/t-Bu chemistry. The assembly was performed on a Rink-amide AM resin (75 mol, 100-200Mesh; loading 0.33 mmol/g) on the Cem Liberty Blue microwave peptide synthesizer (CEM Inc.). During peptide assembly on solid phase, the side chain protecting groups were: tert-butyl for gE; trityl for Asn. Lys starting material was DDe-Lys(Fmoc)—OH. All the amino acids were dissolved at a 0.4 M concentration in DMF. The acylation reactions were performed for 3 min at 90° C. under MW irradiation with 5 folds excess of activated amino acids over the resin free amino groups. Double acylation reactions were performed for 3Pya15. The amino acids were activated with equimolar amounts of 0.5M solution of DIC in DMF and Oxyma solution 1M in DMF.

Intermediate 10-2

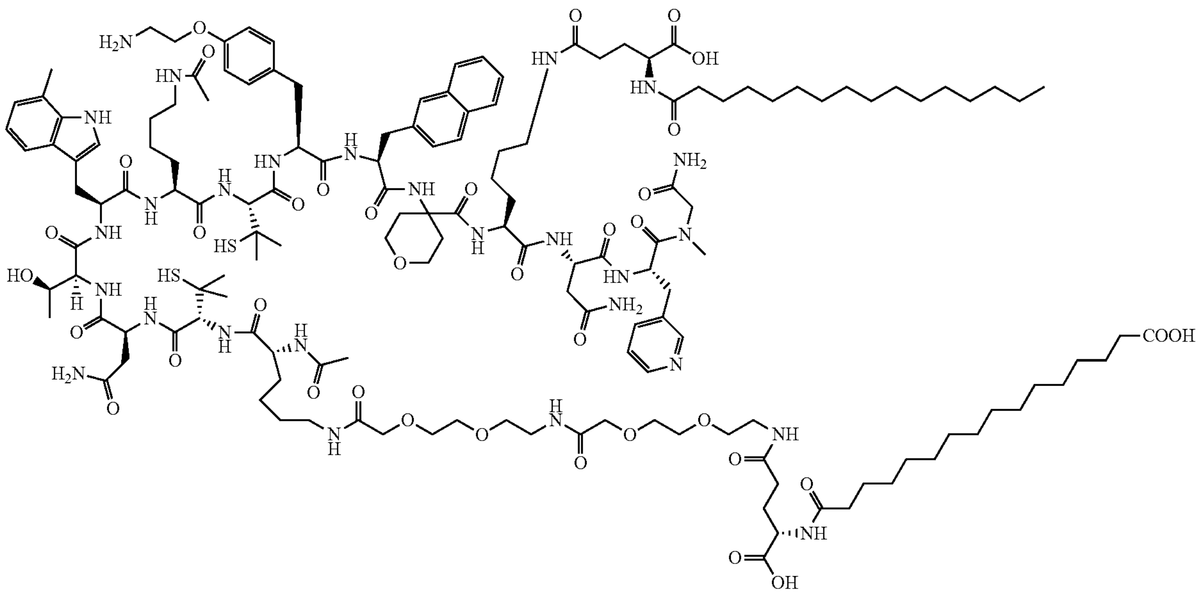

Synthesis of Intermediate 10-2

Intermediate 10-1 was treated with 100 ml of 3% hydrazine solution in DMF to remove the Dde protecting group from Lys. The solution was drained, and the resin washed with DCM (3×5 mL) and DMF (5×5 mL). Assembly was then continued on the Cem Liberty Blue microwave peptide synthesizer using standard coupling conditions. The side chain protecting groups were: tert-butyl for Thr, trityl for Pen and Asn; tert-butoxy-carbonyl for AEF. N-terminal D-Lys residue was protected by the orthogonal DDe protecting group. Double acylation reactions were performed for 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF to remove the Dde protecting group from D-Lys. The solution was drained, and the resin washed with DCM (3×5 mL). The deprotection step was repeated, and then the resin was washed with DCM (5×5 mL), DMF (5×5 mL). Further side chain derivatization was performed manually (PEG2, PEG2 and the gE (Fmoc-Glu-OtBu) residues) using DIC-HOAT (6Eq, 1:1:1) at room temperature. C160H(Hexadecandioic acid) was coupled using DIC-HOAT (10 Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. Then lyophilized to afford the Intermediate 109-2 (94% yield). LCMS anal. calc. For $C_{151}H_{233}N_{27}O_{37}S_2$ 3082.80; found: 1542.2 $(M+2)^{2+}$ Synthesis of MeCO-k (PEG2PEG2gEC160H)-Pen*-N-T-7MeW-K(Ac)-Pen*-AEF-2Nal-THP-K(gEC16)-N-3Pya-Sar-CONH$_2$ Intermediate 10-2 was dissolved in ACN/$H_2O$ (5 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 30% B to 30% B over 5 min, to 45% B over 20 min, flow rate 80 mL/min, wavelength 214 nm. Collected fractions were lyophilized to afford the desired compound (13% yield). LCMS anal. calc. For $C_{151}H_{231}N_{27}O_{37}S_2$ 3080.2; found: 1541.2 $(M+2)^{2+}$.

Example 11. Synthesis of HOC18gEPEG2PEG2-r-Pen*-N-T-7MeW-K(Ac)-Pen*-AEF-2Nal-THP—K(Ac)-N-3Pva-Sar-CONH2(*Pen-Pen form disulfide bond)

Intermediate 11-1

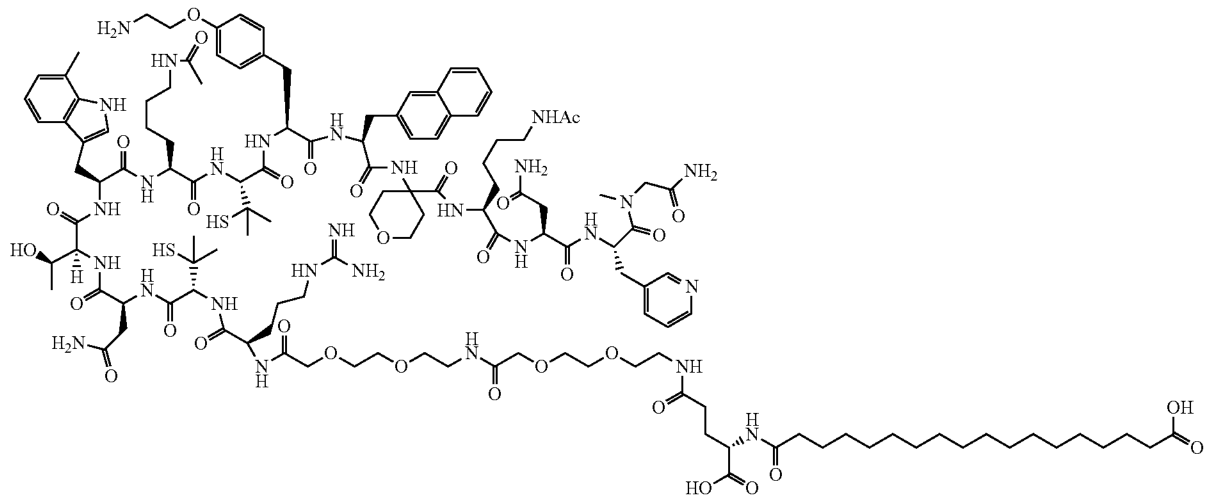

Synthesis of Intermediate 11-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr and Glu; trityl for Pen and Asn; tert-butoxy-carbonyl for AEF, Pbf (2,2,4,6,7-pentamethyldihydrobenzofuran-5-sulfonyl) for Arg. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually (PEG2, PEG2 and the gE (Fmoc-Glu-OtBu) residues) using DIC-HOAT (6Eq, 1:1:1) at room temperature. C18OH (18-(tert-butoxy)-18-oxooctadecanoic acid) was coupled using DIC-HOAT (6Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 11-1 (78.1% yield). LCMS anal. calc. For $C_{132}H_{200}N_{28}O_{33}S_2$ 2771.32; found: 924.7 $(M+3)^{3+}$.

Synthesis of HOC18gEPEG2PEG2-r-Pen*-N-T-7MeW-K(Ac)-Pen*-AEF-2Nal-THP—K(Ac)-N—3Pya-Sar-CONH2

Intermediate 12-1 was dissolved in ACN/$H_2O$ (1 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 80 mL/min, wavelength 214 nm. Collected fractions were lyophilized to afford the desired compound (22% yield). LCMS anal. calc. For $C_{132}H_{198}N_{28}O_{33}S_2$ 2769.32; found: 1386.1 $(M+2)^{2+}$.

Example 12. Synthesis of HOC18gEPEG2PEG2-r-Pen*-N-T-7MeW-K(Ac)-Pen*-AEF-2Nal-THP-K(PEG2PEG2gEC18OH)-N-3Pya-Sar-CONH2(*Pen-Pen form disulfide bond)

Intermediate 12-1

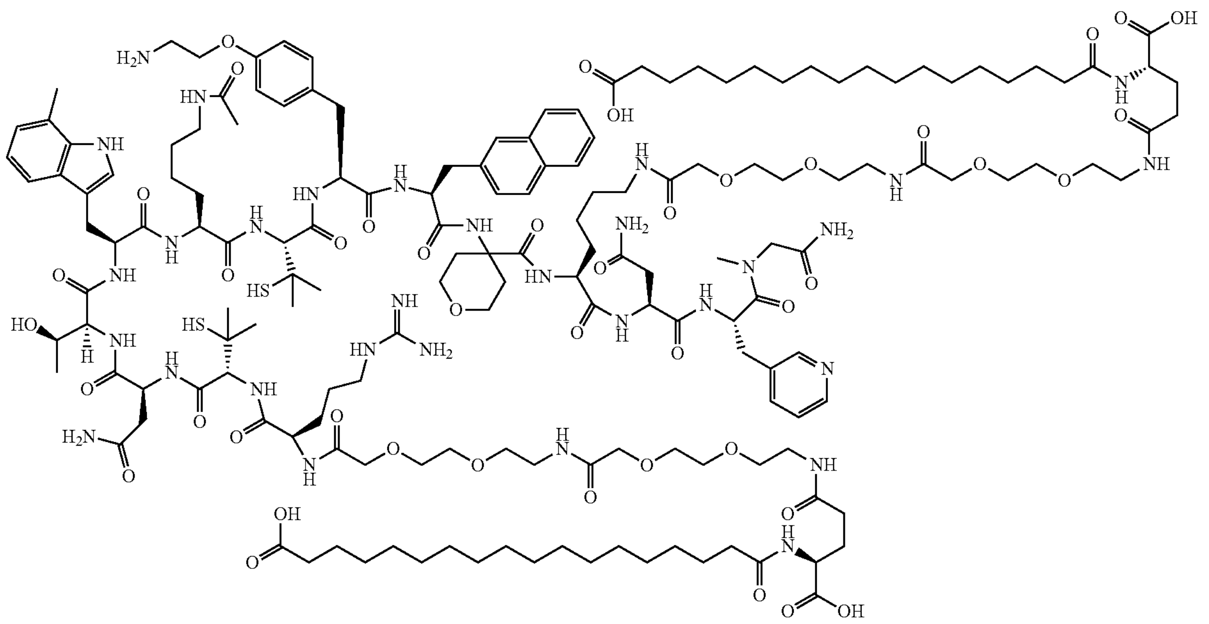

Synthesis of Intermediate 12-1

The peptide was synthesized by standard Solid-phase Peptide Synthesis (SPPS) using Fmoc/t-Bu chemistry. The assembly was performed on a Rink-amide AM resin (73 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; tert-butoxy-carbonyl for AEF, Pbf (2,2,4,6,7-pentamethyldihydrobenzofuran-5-sulfonyl) for Arg. The Lys was protected by the orthogonal DDe protecting group.

All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. At the end of the peptide assembly on solid phase, the resin was treated with 100 ml of 3% hydrazine solution in DMF. The solution was drained, and the resin washed with DCM (5x5 mL) and DMF (5x5 mL). Capping of the free amino group at the N-terminus and Lys13 side chain derivatization was performed manually (PEG2, PEG2 and the gE (Fmoc-Glu-OtBu) residues) using DIC-HOAT (5Eq, 1:1:1) at room temperature. C180H (18-(tert-butoxy)-18-oxooctadecanoic acid) was coupled using DIC-HOAT (5Eq, 1:1:1) at room temperature and complete acylation was monitored by ninhydrin test.

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. Then lyophilized to afford the desired Intermediate 12-1 (80.3% yield). LCMS anal. calc. For $C_{165}H_{259}N_{31}O_{44}S_2$: 3445.16; found: 1149.3 $(M+3)^{3+}$.

Synthesis of HOC18gEPEG2PEG2-$r^3$-Pen*-N-T-7MeW-K(Ac)-Pen*-AEF-2Nal-THP-K(PEG2PEG2gEC180H)-N-3Pya-Sar-$CONH_2$ Intermediate 12-1 was dissolved in ACN/$H_2O$ (5 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x40 mm, 300A, 15 μm). Mobile phase A: +0.1% TFA, mobile phase B: Acetonitrile (ACN)+0.1% TFA. The following gradient of eluent B was used: 30% B to 30% B over 5 min, to 45% B over 25 min, flow rate 80 mL/min, wavelength 214 nm. Collected fractions were lyophilized to afford the desired compound (11.3% yield). LCMS anal. calc. For $C_{165}H_{257}N_{31}O_{44}S_2$: 3443.16; found: 1148.5 $(M+3)^{3+}$.

Example 13. Synthesis of MeCO-k(PEG2PEG2gEC180H)-Pen*-N-T-7MeW-K(Ac)-Pen*-AEF-2Nal-THP-K(Ac)-N-3Pva-N(4AmBenzyl)Gly-CONH2(*Pen-Pen form disulfide bond Intermediate 13-1

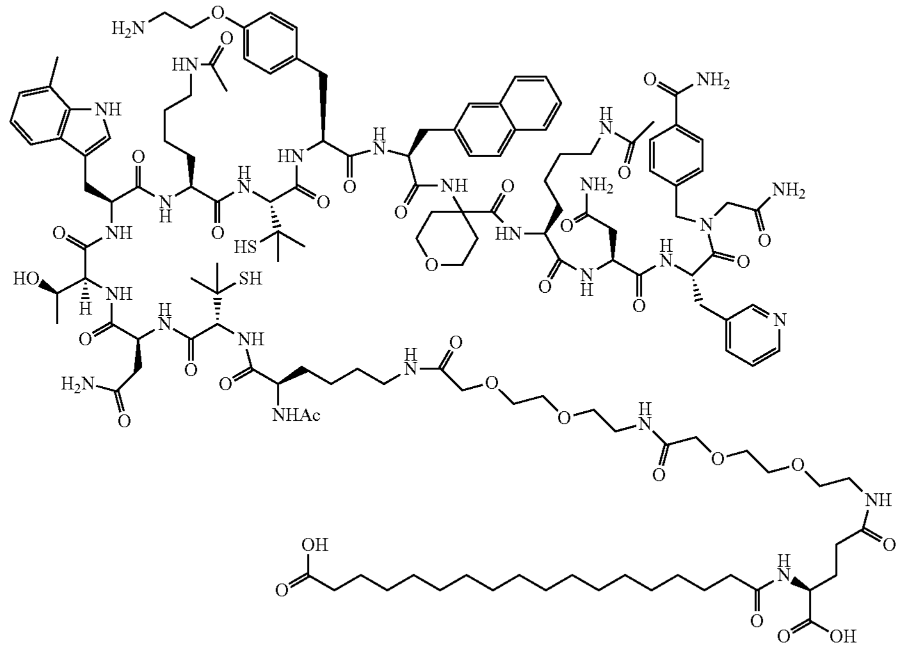

Synthesis of Intermediate 13-1

Peptide assembly was performed on a rink amide MBHA resin (Novabiochem, 73 mol, 100-200Mesh; loading 0.34 mmol/g), by standard Solid-phase Peptide Synthesis (SPPS) using Fmoc/t-Bu chemistry. The resin, after FMOC deprotection was treated with a solution of 4 bromoacetic anhydride (4 eq) in DMF (5 mL) for 30 min at RT. Then, a suspension of 4-amidobenzylamine (7 eq) and DIPEA (7.5 eq) in dry NMP (5 mL) was added to the resin and stirred at RT overnight. The solution was drained, and the resin washed with DCM (3x5 mL) and DMF (3x5 mL). Peptide assembly was continued on the Cem Liberty Blue microwave peptide synthesizer (CEM Inc.), The side chain protecting groups were: tert-butyl for Thr; trityl for Pen and Asn; tert-butoxy-carbonyl for AEF. The D-Lys was protected by the orthogonal DDe protecting group. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF to remove the Dde protecting group from D-Lys3. The solution was drained, and the resin washed with DCM (5x5 mL) and DMF (5x5 mL). Further side chain derivatization was performed manually (PEG2, PEG2 and the gE (Fmoc-Glu-OtBu) residues) using DIC-HOAT (3Eq, 1:1:1) at room temperature. C180H (18-(tert-butoxy)-18-oxooctadecanoic acid) was coupled using DIC-HOAT (6Eq, 1:1:1) at room temperature and complete acylation was monitored by ninhydrin test.

At the end of the assembly the resin was washed with DMF, MeOH, DCM, $Et_2O$. The peptide was cleaved from under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200x25 mm, 300A, 15 µm). Mobile phase A: +0.1% TFA, mobile phase B: Acetonitrile (ACN)+0.1% TFA. The following gradient of eluent B was used: 25% B to 25% B over 5 min, to 40% B over 25 min, flow rate 30 mL/min, wavelength 214 nm. Collected fractions were lyophilized to afford the desired compound (26.8% yield). LCMS anal. calc. For $C_{141}H_{205}N_{27}O_{35}S_2$: 2902.47; found: 1451.9 $(M+2)^{2+}$.

Example 14. Synthesis of MeCO-r-Pen*-N-T-7MeW-K(Ac)-Pen*-AEF-2Nal-THP—K(Ac)-N—3Pva-N(PEG2PEG2gEC180H)Glv-CONH2(*Pen-Pen form disulfide bond)

Intermediate 14-1

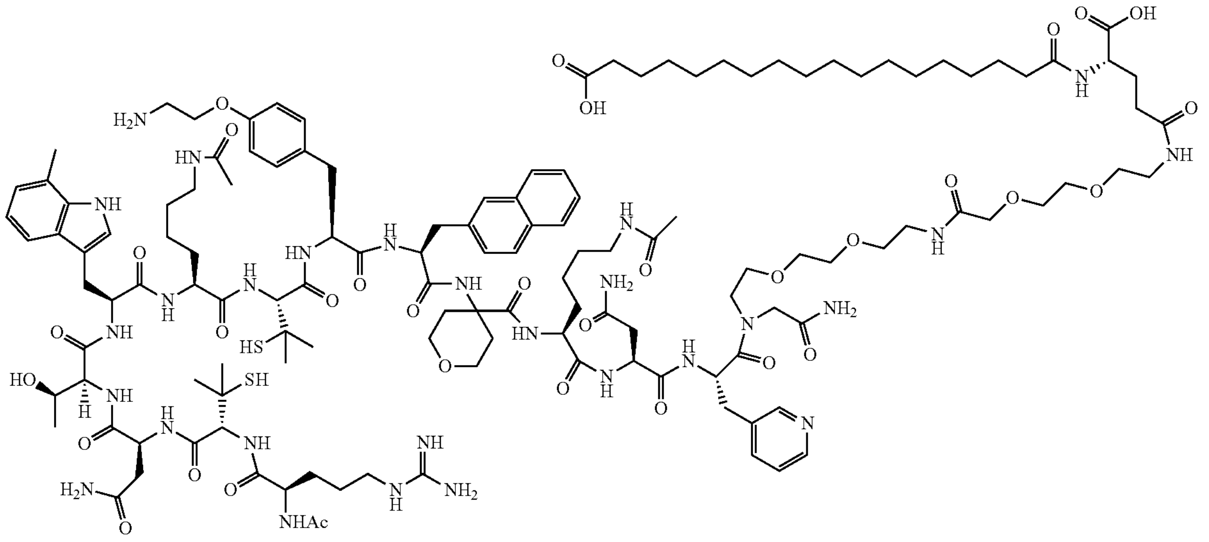

solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. Then lyophilized to afford the desired Intermediate 13-1 (38% yield). LCMS anal. calc. For $C_{141}H_{207}N_{27}O_{35}S_2$: 2904.47; found 1452.6 $(M+2)^{2+}$.

Synthesis of MeCO-k(PEG2PEG2gEC180H)-Pen*-N-T-7MeW-K(Ac)-Pen*-AEF-2Nal-THP—K(Ac)-N-3Pya-N(4AmBenzyl)Gly-CONH2

Intermediate 13-1 was dissolved in ACN/$H_2O$ (5 mg/ml). Saturated Iodine in acetic acid was then added dropwise Synthesis of Intermediate 14-1

Peptide assembly was performed on a rink amide MBHA resin (Novabiochem, 73 mol, 100-200Mesh; loading 0.34 mmol/g), by standard Solid-phase Peptide Synthesis (SPPS) using Fmoc/t-Bu chemistry. The resin, after FMOC deprotection was treated with a solution of 4 bromoacetic anhydride (4 eq) in DMF (5 mL) for 30 min at RT. Then, a solution of Bis-amino-PEG2 (7 eq) in dry NMP (5 mL) was added to the resin and stirred at RT overnight. The solution was drained, and the resin was treated with a solution of Dde-OH (3 eq) in DMF (5 mL) for 1 h at RT. The solution was drained, and the resin washed with DCM (3x5 mL) and DMF (3x5 mL). Peptide assembly was continued on the Cem Liberty Blue microwave peptide synthesizer (CEM Inc.), by standard Solid-phase Peptide Synthesis (SPPS) using Fmoc/t-Bu chemistry. The side chain protecting groups were: tert-butyl for Thr; trityl for Pen and Asn; tert-butoxy-carbonyl for AEF, Pbf (2,2,4,6,7-pentamethyl-dihydrobenzofuran-5-sulfonyl) for Arg. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF.

At the end of the peptide assembly on solid phase, the resin was treated with 100 ml of 3% hydrazine solution in DMF. The solution was drained, and the resin washed with DCM (5×5 mL) and DMF (5×5 mL). Further side chain derivatization was performed manually (gE (Fmoc-Glu-OtBu) and C18OH (18-(tert-butoxy)-18-oxooctadecanoic acid) residues) using DIC-HOAT (3Eq, 1:1:1) at room temperature and complete acylation was monitored by ninhydrin test.

Synthesis of MeCO-r-Pen*-N-T-7MeW-K(Ac)-Pen*-AEF-2Nal-THP—K(Ac)-N-3Pya-N(PEG2PEG2gEC18OH)Gly-CONH2

Intermediate 14-1 was dissolved in ACN/$H_2O$ (5 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 30% B to 30% B over 5 min, to 45% B over 25 min, flow rate 80 mL/min, wavelength 214 nm. Collected fractions were lyophilized to afford the desired compound (19.6% yield). LCMS anal. calc. For $C_{133}H_{200}N_{28}O_{33}S_2$: 2783.35; found: 1392.1 $(M+2)^{2+}$.

Example 15. Synthesis of MeCO-k(PEG2PEG2gEDab(mXOH)2)-Pen*-N-T-7MeW-K(Ac)-Pen*-AEF-2Nal-THP—K(Ac)-N-3Pva-Sar-CONH2(*Pen-Pen form disulfide bond)

Intermediate 15-1

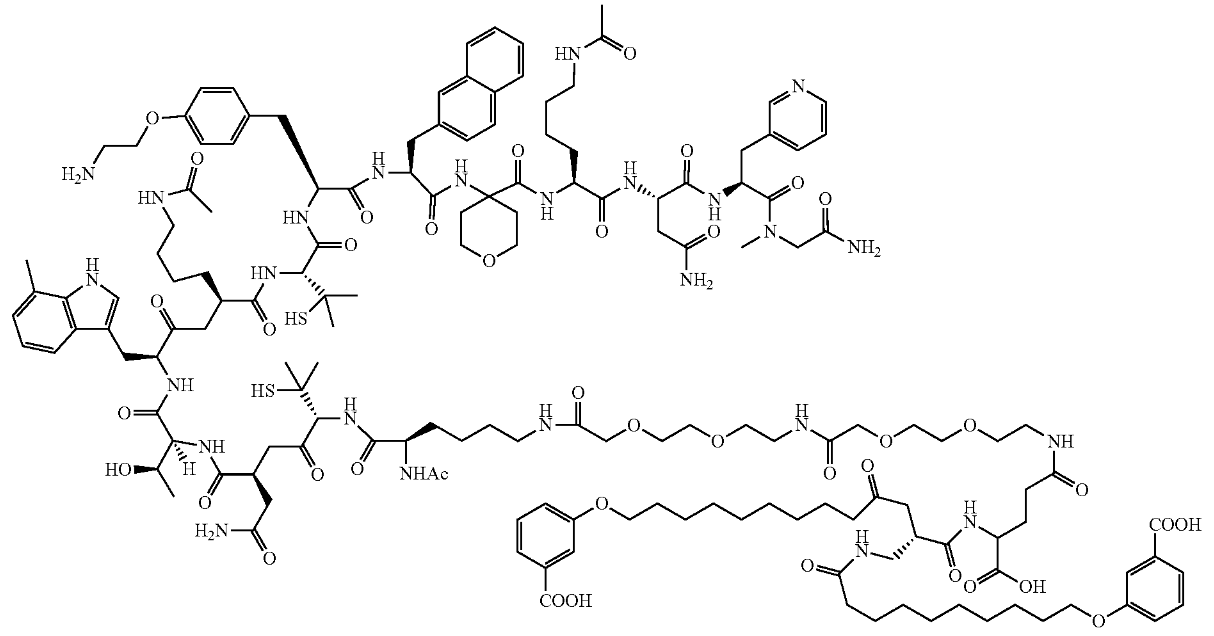

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. Then lyophilized to afford the desired Intermediate 14-1 (76.7% yield). LCMS anal. calc. For $C_{133}H_{202}N_{28}O_{33}S_2$ 2785.35; found: 1393.4 $(M+2)^{2+}$.

Synthesis of Intermediate 15-1

The peptide was synthesized by standard Solid-phase Peptide Synthesis (SPPS) using Fmoc/t-Bu chemistry. The assembly was performed on a Rink-amide AM resin (220 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr; trityl for Pen and Asn; tert-butoxy-carbonyl for AEF, Pbf (2,2,4,6,7-pentamethyldihydrobenzofuran-5-sulfonyl) for Arg. The D-Lys was protected by the orthogonal DDe protecting group. All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (5×5 mL) and DMF (5×5 mL). Further side chain derivatization was performed manually (PEG2, PEG2, gE (Fmoc-Glu-OtBu) and Dap (Fmoc-Dap(DDe)—OH)) using DIC-HOAt (5Eq, 1:1:1) at room temperature. At the end of the peptide assembly on solid phase, the resin was treated with 100 ml of 3% hydrazine solution in DMF to remove the Dde protecting group from Dap. The solution was drained, and the resin washed with DCM (5×5 mL) and DMF (5×5 mL). Further side chain derivatization was performed manually using mXOH (10-(3-(tert-butoxycarbonyl)phenoxy)decanoic acid), DIC, HOAt (4Eq, 1:1:1) at room temperature and complete acylation was monitored by ninhydrin test.

At the end of the assembly the resin was washed with DMF, MeOH, DCM, $Et_2O$. The peptide was cleaved from solid support using 30 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the desired Intermediate 131-1 (75.6% yield). LCMS anal. calc. LCMS anal. calc. For $C_{141}H_{217}N_{28}O_{35}S_2$+: 3155.72; found: 1053.1 $(M+3)^{3+}$.

Synthesis of MeCO-k(PEG2PEG2gEDab(mXOH)2)-Pen*-N-T-7MeW-K(Ac)-Pen*-AEF-2Nal-THP—K(Ac)-N-3Pya-Sar-$CONH_2$ Intermediate 15-1 was dissolved in ACN/$H_2O$ (1 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 30% B to 30% B over 5 min, to 45% B over 25 min, flow rate 80 mL/min, wavelength 214 nm. Collected fractions were lyophilized to afford the desired compound (14% yield). LCMS anal. calc. For $C_{153}H_{218}N_{28}O_{40}S_2$: 3153.7; found: 1578 $(M+2)^{2+}$.

Example 16. Synthesis of MeCO-k(PEG2PEG2gE(c)C180H)-Pen*-N-T-7MeW-K(Ac)-Pen*-AEF-2Nal-THP—K(Ac)-N-3Pva-Sar-CONH2 (*Pen-Pen form disulfide bond)

Intermediate 16-1

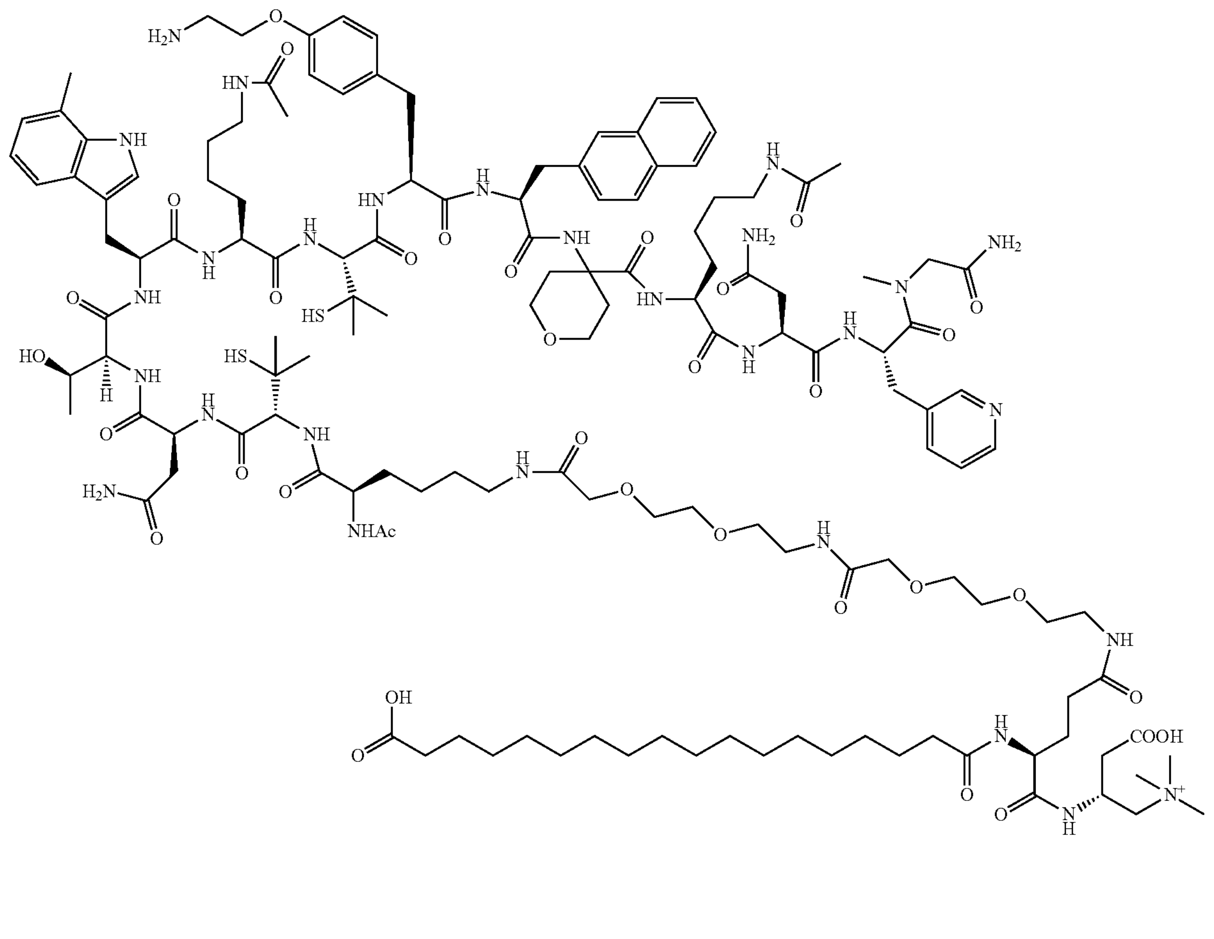

Synthesis of Intermediate 16-1

The peptide was synthesized by standard Solid-phase Peptide Synthesis (SPPS) using Fmoc/t-Bu chemistry. The assembly was performed on a Rink-amide AM resin (110 mol, 100-200Mesh; loading 0.33 mmol/g) on the Cem Liberty Blue microwave peptide synthesizer (CEM Inc.). During peptide assembly on solid phase, the side chain protecting groups were: tert-butyl for Thr and Glu; trityl for Pen and Asn; tert-butoxy-carbonyl for AEF. The D-Lys was protected by the orthogonal DDe protecting group.

All the amino acids were dissolved at a 0.4 M concentration in DMF. The acylation reactions were performed for 3 min at 90° C. under MW irradiation with 5 folds excess of activated amino acids over the resin free amino groups. The amino acids were activated with equimolar amounts of 0.5M solution of DIC in DMF and Oxyma solution 1M in DMF. Double acylation reactions were performed for 3Pya and 2Nal. Fmoc deprotections were performed using 20% (V/V) piperidine in DMF. Capping of the free amino group was performed manually using 10eq of acetic anhydride in DMF. At the end of the peptide assembly on solid phase, the resin was treated with 100 ml of 3% hydrazine solution in DMF. The solution was drained, and the resin washed with DCM (5×5 mL) and DMF (5×5 mL). Further side chain derivatization was performed manually (PEG2, PEG2 and the gE ((S,E)-4-((Fmoc)amino)-5-oxo-5-(prop-1-en-1-yloxy)pentanoic acid) residues) using DIC-HOAT (3Eq, 1:1:1) at room temperature. C18OH (18-(tert-butoxy)-18-oxooctadecanoic acid) was coupled using DIC-HOAT (6Eq, 1:1:1) at room temperature and complete acylation was monitored by ninhydrin test. The resin was then treated with 0.25Eq of Pd Tetrakis, 24 Eq of Phenylsilane in 5 ml of DCM Dry under N2 atmosphere for 30 min (process repeated 2 times); washed with DCM, DMF and a solution of 0.5% sodium dimethyldithiocarbamate (0.5%) and DIPEA (0.5%) in DMF. The resin was then manually preactivated with HATU (1.2Eq) and dipea (2Eq) and was left under stirring for 10 minutes. Amino-carnitine (2 Eq; (R)-2-amino-4-(tert-butoxy)-N,N,N-trimethyl-4-oxobutan-1-aminium) was added. Reaction was completed after 2 hr (monitored by test cleavage).

At the end of the assembly the resin was washed with DMF, MeOH, DCM, $Et_2O$. The peptide was cleaved from solid support using 15 ml of TFA solution (v/v) (87.5% TFA, 5% $H_2O$, 2.5% TIPS, 5% Phenol) for approximately 1.5 hours, at room temperature. The resin was then filtered and precipitated in cold MTBE (135 mL). After centrifugation, the peptide pellets were washed with fresh cold diethyl-ether to remove the organic scavengers. The process was repeated twice. Final pellets were dried, re-suspended in $H_2O$ and acetonitrile 1:1+0.1% TFA and stirred overnight. The mixture was then lyophilized to afford the Intermediate 142-1 (73.6% yield). LCMS anal. calc. For $C_{141}H_{217}N_{28}O_{35}S_2$+: 2928.55; found: 1464.74 $(M+2)^{2+}$.

Synthesis of MeCO-k(PEG2PEG2gE(c)C18OH)-Pen*-N-T-7MeW-K(Ac)-Pen*-AEF-2Nal-THP—K (Ac)-N-3Pya-Sar-CONH2

Intermediate 16-1 was dissolved in ACN/$H_2O$ (1 mg/ml). Saturated Iodine in acetic acid was then added dropwise under stirring until yellow color persisted. Reaction was completed in 30 min (monitored by UPLC-MS). Solid ascorbic acid was added until the solution became clear. After lyophilization the cyclized peptide was purified by reverse-phase HPLC using preparative Waters DeltaPak C4 (200×40 mm, 300A, 15 μm). Mobile phase A: +0.1% TFA, mobile phase B: Acetonitrile (ACN)+0.1% TFA. The following gradient of eluent B was used: 20% B to 20% B over 5 min, to 35% B over 25 min, flow rate 80 mL/min, wavelength 214 nm. Collected fractions were lyophilized to afford the desired compound (20% yield). LCMS anal. calc. For $C_{141}H_{215}N_{28}O_{35}S_2$+: 2926.55; found 1463.9 $(M+2)^{2+}$.

Examples 17-142. Synthesis

Additional compounds have been prepared according to the methods described above, with illustrative data as shown in Table 3 below. In all the Examples, * indicate that Pen-Pen form a disulfide bond.

TABLE 3

Compound Synthesis

| Example | Name | MS Data | Synthetic Procedure (Example) |
|---|---|---|---|
| 17 | MeCO-r-Pen*-N-T-7MeW-K(Ac)-Pen*-AEF-2Nal-THP-E-N-3Pya-Sar-K(PEG2PEG2gEC16OH)-$CONH_2$ | 1436.6 | 2 |
| 18 | MeCO-r-Pen*-N-T-7MeW-K(Ac)-Pen*-AEF-2Nal-THP-E-N-3Pya-K(PEG2PEG2gEC18OH)-$CONH_2$ | 1414.9 | 2 |
| 19 | MeCO-Pen*-N-T-7MeW-K(Ac)-Pen*-AEF-2Nal-THP-K(PEG2PEG2gEC16OH)-N-3Pya-Sar-$CONH_2$ | 1293.4 | 24 |
| 20 | MeCO-r-Pen*-K(PEG2PEG2gEC18OH)-T-7MeW-K(Ac)-Pen*-AEF-2Nal-THP-E-N-3Pya-Sar-$CONH_2$ | 1393.3 | 2 |
| 21 | MeCO-r-Pen*-K(PEG2PEG2gEC16OH)-T-7MeW-K(Ac)-Pen*-AEF-2Nal-THP-E-N-3Pya-Sar-$CONH_2$ | 1379.1 | 2 |
| 22 | MeCO-r-Pen*-N-T-7MeW-K(Ac)-Pen*-AEF-2Nal-THP-E-N-3Pya-NMeK(PEG2PEG2gEC16OH)-$CONH_2$ | 1407.9 | 23 |
| 23 | MeCO-r-Pen*-N-T-7MeW-K(Ac)-Pen*-AEF-2Nal-THP-E-N-3Pya-K(PEG2PEG2gEC16OH)-$CONH_2$ | 1400.8 | 2 |
| 24 | HOC16gEPEG2PEG2-r-Pen*-N-T-7MeW-K(Ac)-Pen*-AEF-2Nal-THP-K(Ac)-N-3Pya-Sar-$CONH_2$ | 1371.5 | 11 |
| 25 | MeCO-K(PEG2PEG2gEC16OH)-Pen*-N-T-7MeW-K(Ac)-Pen*-AEF-2Nal-THP-K(Ac)-N-3Pya-Sar-$CONH_2$ | 1378.5 | 25 |

TABLE 3-continued

| Compound Synthesis | | | |
|---|---|---|---|
| Example | Name | MS Data | Synthetic Procedure (Example) |
| 26 | MeCO-r-Pen*-N-T-7MeW-K(Ac)-Pen*-AEF(PEG2PEG2gEC16OH)-2Nal-THP-K(Ac)-N-3Pya-Sar-$CONH_2$ | 1392.2 | 26 |
| 27 | MeCO-r-Pen*-N-T-7MeW-K(Ac)-Pen*-AEF-2Nal-THP-K(PEG2PEG2gEC18OH)-N-3Pya-Sar-$CONH_2$ | 1385.3 | 4 |
| 28 | MeCO-r-Pen*-N-T-7MeW-K(Ac)-Pen*-AEF-2Nal-THP-K(PEG2PEG2gEC16OH)-N-3Pya-Sar-$CONH_2$ | 1371.2 | 4 |
| 29 | MeCO-Pen*-N-T-7MeW-K(Ac)-Pen*-AEF-2Nal-THP-K(gEC16OH)-N-3Pya-Sar-$CONH_2$ | 1148.1 | 24 |
| 30 | MeCO-Pen*-N-T-7MeW-K(Ac)-Pen*-AEF-2Nal-THP-K(gEC18OH)-N-3Pya-Sar-$CONH_2$ | 1162.1 | 24 |
| 31 | MeCO-Pen*-N-T-7MeW-K(Ac)-Pen*-AEF-2Nal-THP-K(gEC18)-N-3Pya-Sar-$CONH_2$ | 1147.3 | 24 |
| 32 | MeCO-Pen*-N-T-7MeW-K(Ac)-Pen*-AEF-2Nal-THP-K(PEG6gEC16OH)-N-3Pya-Sar-$CONH_2$ | 1315.6 | 24 |
| 33 | MeCO-Pen*-N-T-7MeW-K(Ac)-Pen*-AEF-2Nal-THP-K(PEG6gEC18OH)-N-3Pya-Sar-$CONH_2$ | 1329.7 | 24 |
| 34 | MeCO-Pen*-N-T-7MeW-K(Ac)-Pen*-AEF-2Nal-THP-K(PEG2gEC16OH)-N-3Pya-Sar-$CONH_2$ | 1220.6 | 24 |
| 35 | MeCO-Pen*-N-T-7MeW-K(Ac)-Pen*-AEF-2Nal-THP-K(PEG2gEC18OH)-N-3Pya-Sar-$CONH_2$ | 1234.6 | 24 |
| 36 | MeCO-Pen*-N-T-7MeW-K(Ac)-Pen*-AEF-2Nal-THP-K(PEG2PEG2gEC20OH)-N-3Pya-Sar-$CONH_2$ | 1321.6 | 24 |
| 37 | HOC16gEPEG2PEG2-r-Pen*-N-T-7MeW-K(Ac)-Pen*-AEF-2Nal-THP-K(PEG2PEG2gEC16OH)-N-3Pya-Sar-$CONH_2$ | 1129.9 | 112 |
| 38 | MeCO-Pen*-N-T-7MeW-K(Ac)-Pen*-AEF-2Nal-THP-K(PEG2PEG6gEC16OH)-N-3Pya-Sar-$CONH_2$ | 1388.4 | 24 |
| 39 | MeCO-Pen*-N-T-7MeW-K(Ac)-Pen*-AEF-2Nal-THP-K(PEG2PEG6gEC18OH)-N-3Pya-Sar-$CONH_2$ | 935 | 24 |
| 40 | MeCO-Pen*-N-T-7MeW-K(Ac)-Pen*-AEF-2Nal-THP-K(PEG2PEG2C16OH)-N-3Pya-Sar-$CONH_2$ | 1229.2 | 24 |
| 41 | MeCO-Pen*-N-T-7MeW-K(Ac)-Pen*-AEF-2Nal-THP-K(PEG2PEG2C18OH)-N-3Pya-Sar-$CONH_2$ | 1242.8 | 24 |
| 42 | MeCO-Pen*-N-T-7MeW-K(Ac)-Pen*-AEF-2Nal-THP-K(PEG6PEG6gEC16OH)-N-3Pya-Sar-$CONH_2$ | 989.1 | 24 |
| 43 | MeCO-Pen*-N-T-7MeW-K(Ac)-Pen*-AEF-2Nal-THP-K(PEG6PEG6gEC18OH)-N-3Pya-Sar-$CONH_2$ | 998.7 | 24 |
| 44 | MeCO-Pen*-N-T-7MeW-K(Ac)-Pen*-AEF-2Nal-THP-K(PEG24gEC16OH)-N-3Pya-Sar-$CONH_2$ | 1141.6 | 24 |
| 45 | MeCO-Pen*-N-T-7MeW-K(Ac)-Pen*-AEF-2Nal-THP-K(PEG24gEC18OH)-N-3Pya-Sar-$CONH_2$ | 1151.2 | 24 |
| 46 | MeCO-Pen*-N-T-7MeW-K(Ac)-Pen*-AEF-2Nal-THP-K(Ac)-N-3Pya-Sar-PEG2PEG2eKC18OH-COOH | 1328.2 | 8 |
| 47 | MeCO-Pen*-N-T-7MeW-K(Ac)-Pen*-AEF-2Nal-THP-K(PEG24C18OH)-N-3Pya-Sar-$CONH_2$ | 1108.3 | 24 |
| 48 | MeCO-K(gEC18OH)-Pen*-N-T-7MeW-K(Ac)-Pen*-AEF-2Nal-THP-K(Ac)-N-3Pya-Sar-$CONH_2$ | 1247.2 | 25 |
| 49 | MeCO-K(PEG2gEC18OH)-Pen*-N-T-7MeW-K(Ac)-Pen*-AEF-2Nal-THP-K(Ac)-N-3Pya-Sar-$CONH_2$ | 1319.5 | 25 |
| 50 | MeCO-r-Pen*-K(PEG2PEG2gEC18OH)-T-7MeW-K(Ac)-Pen*-AEF-2Nal-THP-K(Ac)-N-3Pya-Sar-$CONH_2$ | 1413.4 | 2 |
| 51 | MeCO-r-Pen*-K(gEC18OH)-T-7MeW-K(Ac)-Pen*-AEF-2Nal-THP-K(Ac)-N-3Pya-Sar-$CONH_2$ | 1268.1 | 2 |
| 52 | MeCO-r-Pen*-K(PEG2gE C18OH)-T-7MeW-K(Ac)-Pen*-AEF-2Nal-THP-K(Ac)-N-3Pya-Sar-$CONH_2$ | 1340.4 | 2 |
| 53 | MeCO-r-Pen*-K(PEG2PEG2C18OH)-T-7MeW-K(Ac)-Pen*-AEF-2Nal-THP-K(Ac)-N-3Pya-Sar-$CONH_2$ | 1349.1 | 2 |
| 54 | MeCO-r-Pen*-N-T-7MeW-K(Ac)-Pen*-AEF-2Nal-THP-K(Ac)-N-3Pya-NMeK(PEG2PEG2gEC18OH)-$CONH_2$ | 1442 | 23 |
| 55 | MeCO-r-Pen*-N-T-7MeW-K(Ac)-Pen*-AEF-2Nal-THP-K(PEG2PEG2DgEC18OH)-N-3Pya-Sar-$CONH_2$ | 1385.3 | 24 |
| 56 | MeCO-r-Pen*-N-T-7MeW-K(Ac)-Pen*-AEF-2Nal-THP-K(PEG2PEG2PC18OH)-N-3Pya-Sar-$CONH_2$ | 1369.1 | 24 |
| 57 | MeCO-r-Pen*-N-T-7MeW-K(Ac)-Pen*-AEF-2Nal-THP-K(PEG2PEG2pC18OH)-N-3Pya-Sar-$CONH_2$ | 1369.1 | 24 |

TABLE 3-continued

| Compound Synthesis | | | |
|---|---|---|---|
| Example | Name | MS Data | Synthetic Procedure (Example) |
| 58 | MeCO-r-Pen*-N-T-7MeW-K(Ac)-Pen*-AEF-2Nal-THP-K(PEG2PEG2gETrxC18OH)-N-3Pya-Sar-$CONH_2$ | 1454.9 | 24 |
| 59 | MeCO-r-Pen*-N-T-7MeW-K(Ac)-Pen*-AEF-2Nal-THP-K(PEG2PEG2gETrxC20OH)-N-3Pya-Sar-$CONH_2$ | 1468.7 | 24 |
| 60 | MeCO-k(PEG6 gE C18OH)-Pen*-N-T-7MeW-K(Ac)-Pen*-AEF-2Nal-THP-K(Ac)-N-3Pya-Sar-$CONH_2$ | 1414.7 | 25 |
| 61 | MeCO-k(PEG2PEG6 gE C18OH)-Pen*-N-T-7MeW-K(Ac)-Pen*-AEF-2Nal-THP-K(Ac)-N-3Pya-Sar-$CONH_2$ | 991.9 | 25 |
| 62 | MeCO-K(PEG2PEG2 C18OH)-Pen*-N-T-7MeW-K(Ac)-Pen*-AEF-2Nal-THP-K(Ac)-N-3Pya-Sar-$CONH_2$ | 1327.8 | 25 |
| 63 | MeCO-r-Pen*-K(PEG6gEC18OH)-T-7MeW-K(Ac)-Pen*-AEF-2Nal-THP-K(Ac)-N-3Pya-Sar-$CONH_2$ | 1435.7 | 2 |
| 64 | MeCO-r-Pen*-K(PEG2PEG6 gE C18OH)-T-7MeW-K(Ac)-Pen*-AEF-2Nal-THP-K(Ac)-N-3Pya-Sar-$CONH_2$ | 1508.4 | 2 |
| 65 | MeCO-r-Pen*-N-T-7MeW-K(Ac)-Pen*-AEF-2Nal-THP-K(PEG2PEG2PPPC18OH)-N-3Pya-Sar-$CONH_2$ | 978.2 | 24 |
| 66 | MeCO-r-Pen*-N-T-7MeW-K(Ac)-Pen*-AEF-2Nal-THP-K(PEG2PEG2pppC18OH)-N-3Pya-Sar-$CONH_2$ | 978.2 | 24 |
| 67 | MeCO-k(gEC16)-Pen*-N-T-7MeW-K(Ac)-Pen*-AEF-2Nal-THP-K(Ac)-N-3Pya-Sar-$CONH_2$ | 1218.5 | 25 |
| 68 | MeCO-k(gEC18)-Pen*-N-T-7MeW-K(Ac)-Pen*-AEF-2Nal-THP-K(Ac)-N-3Pya-Sar-$CONH_2$ | 1232.2 | 25 |
| 69 | MeCO-r-Pen*-K(gEC16)-T-7MeW-K(Ac)-Pen*-AEF-2Nal-THP-K(Ac)-N-3Pya-Sar-$CONH_2$ | 1239.4 | 2 |
| 70 | MeCO-r-Pen*-K(gEC18)-T-7MeW-K(Ac)-Pen*-AEF-2Nal-THP-K(Ac)-N-3Pya-Sar-$CONH_2$ | 1253.3 | 2 |
| 71 | MeCO-K(PEG2PEG2gETrxC18OH)-Pen*-N-T-7MeW-K(Ac)-Pen*-AEF-2Nal-THP-K(Ac)-N-3Pya-Sar-$CONH_2$ | 1461.8 | 25 |
| 72 | MeCO-K(PEG2PEG2gETrxC20OH)-Pen*-N-T-7MeW-K(Ac)-Pen*-AEF-2Nal-THP-K(Ac)-N-3Pya-Sar-$CONH_2$ | 1476.3 | 25 |
| 73 | MeCO-Pen*-K(PEG2PEG2gETrxC18OH)-T-7MeW-K(Ac)-Pen*-AEF-2Nal-THP-K(Ac)-N-3Pya-Sar-$CONH_2$ | 1405 | 2 |
| 74 | MeCO-Pen*-K(PEG2PEG2gETrxC20OH)-T-7MeW-K(Ac)-Pen*-AEF-2Nal-THP-K(Ac)-N-3Pya-Sar-$CONH_2$ | 1419.2 | 2 |
| 75 | MeCO-Pen*-N-T-7MeW-K(Ac)-Pen*-AEF-2Nal-THP-K(gEC16)-N-3Pya-Sar-$CONH_2$ | 1133.2 | 24 |
| 76 | MeCO-K(PEG2PEG2gEC16OH)-Pen*-K(PEG2PEG2gEC16OH)-T-7MeW-K(Ac)-Pen*-AEF-2Nal-THP-K(Ac)-N-3Pya-Sar-$CONH_2$ | 1729.2 | 9 |
| 77 | MeCO-K(PEG2PEG2gEC18OH)-Pen*-K(PEG2PEG2gEC18OH)-T-7MeW-K(Ac)-Pen*-AEF-2Nal-THP-K(Ac)-N-3Pya-Sar-$CONH_2$ | 1758 | 9 |
| 78 | MeCO-K(PEG2PEG2gEC20OH)-Pen*-K(PEG2PEG2gEC20OH)-T-7MeW-K(Ac)-Pen*-AEF-2Nal-THP-K(Ac)-N-3Pya-Sar-$CONH_2$ | 1785.9 | 9 |
| 79 | MeCO-K(gEC16)-Pen*-K(gEC16)-T-7MeW-K(Ac)-Pen*-AEF-2Nal-THP-K(Ac)-N-3Pya-Sar-$CONH_2$ | 1409 | 9 |
| 80 | MeCO-K(gEC18)-Pen*-K(gEC18)-T-7MeW-K(Ac)-Pen*-AEF-2Nal-THP-K(Ac)-N-3Pya-Sar-$CONH_2$ | 1437.4 | 9 |
| 81 | MeCO-K(PEG2PEG2gEC16)-Pen*-N-T-7MeW-K(Ac)-Pen*-AEF-2Nal-THP-K(Ac)-N-3Pya-Sar-$CONH_2$ | 1363.4 | 25 |
| 82 | MeCO-K(PEG2PEG2gEC18)-Pen*-N-T-7MeW-K(Ac)-Pen*-AEF-2Nal-THP-K(Ac)-N-3Pya-Sar-$CONH_2$ | 1377.5 | 25 |
| 83 | MeCO-Pen*-K(PEG2PEG2gEC16)-T-7MeW-K(Ac)-Pen*-AEF-2Nal-THP-K(Ac)-N-3Pya-Sar-$CONH_2$ | 1306.5 | 2 |
| 84 | MeCO-Pen*-K(PEG2PEG2gEC18)-T-7MeW-K(Ac)-Pen*-AEF-2Nal-THP-K(Ac)-N-3Pya-Sar-$CONH_2$ | 1320.4 | 2 |

TABLE 3-continued

| Example | Name | MS Data | Synthetic Procedure (Example) |
|---|---|---|---|
| | Compound Synthesis | | |
| 85 | MeCO-Pen*-K(PEG2PEG2gEC16OH)-T-7MeW-K(Ac)-Pen*-AEF-2Nal-THP-K(Ac)-N-3Pya-Sar-$CONH_2$ | 881.3 | 2 |
| 86 | MeCO-K(PEG2gEC18OH)-Pen*-N-T-7MeW-K(Ac)-Pen*-AEF-2Nal-THP-K(Ac)-N-3Pya-N(4AmBenzyl)Gly-$CONH_2$ | 1379.4 | 13 |
| 87 | MeCO-K(gEC18OH)-Pen*-N-T-7MeW-K(Ac)-Pen*-AEF-2Nal-THP-K(Ac)-N-3Pya-N(4AmBenzyl)Gly-$CONH_2$ | 1306.9 | 13 |
| 88 | MeCO-r-Pen*-N-T-7MeW-K(PEG2PEG2gEC18OH)-Pen*-AEF-2Nal-THP-K(Ac)-N-3Pya-Sar-$CONH_2$ | 1385.8 | 2 |
| 89 | MeCO-Pen*-N-T-7MeW-K(Ac)-Pen*-AEF-2Nal-THP-K(gEC20OH)-N-3Pya-Sar-$CONH_2$ | 1176.3 | 24 |
| 90 | MeCO-Pen*-N-T-7MeW-K(Ac)-Pen*-AEF-2Nal-THP-K(PEG2PEG2TrxgEC18OH)-N-3Pya-Sar-$CONH_2$ | 1376.8 | 24 |
| 91 | MeCO-Pen*-N-T-7MeW-K(Ac)-Pen*-AEF-2Nal-THP-K(PEG2PEG2TrxgETrxC20OH)-N-3Pya-Sar-$CONH_2$ | 1460.3 | 24 |
| 92 | MeCO-Pen*-N-T-7MeW-K(Ac)-Pen*-AEF-2Nal-THP-K(PEG2PEG2TrxgEC20OH)-N-3Pya-Sar-$CONH_2$ | 927.6 | 24 |
| 93 | MeCO-K(PEG2PEG2gEC10OH)-Pen*-N-T-7MeW-K(Ac)-Pen*-AEF-2Nal-THP-K(gEC16)-N-3Pya-Sar-$CONH_2$ | 1499.1 | 10 |
| 94 | MeCO-K(PEG2PEG2gEC18OH)-Pen*-K(gEc16)-T-7MeW-K(Ac)-Pen*-AEF-2Nal-THP-K(Ac)-N-3Pya-Sar-$CONH_2$ | 1583.1 | 10 |
| 95 | MeCO-r-Pen*-K(PEG2PEG2PgEC18OH)-T-7MeW-K(Ac)-Pen*-AEF-2Nal-THP-K(Ac)-N-3Pya-Sar-$CONH_2$ | 975.1 | 2 |
| 96 | MeCO-r-Pen*-K(PEG2PEG2pgEC18OH)-T-7MeW-K(Ac)-Pen*-AEF-2Nal-THP-K(Ac)-N-3Pya-Sar-$CONH_2$ | 975.2 | 2 |
| 97 | MeCO-Pen*-N-T-7MeW-K(Ac)-Pen*-AEF-2Nal-THP-K(PEG2PEG2gEmXOH)-N-3Pya-Sar-$CONH_2$ | 1304.4 | 24 |
| 98 | MeCO-K(PEG2PEG2gEC18OH)-Pen*-N-T-7MeW-K(Ac)-Pen*-AEF-2Nal-THP-K(gEc16)-N-3Pya-Sar-$CONH_2$ | 1555.1 | 10 |
| 99 | MeCO-r-Pen*-K(PEG2PEG2PPPgEC18OH)-T-7MeW-K(Ac)-Pen*-AEF-2Nal-THP-K(Ac)-N-3Pya-Sar-$CONH_2$ | 1039.7 | 2 |
| 100 | MeCO-r-Pen*-K(PEG2PEG2pppgEC18OH)-T-7MeW-K(Ac)-Pen*-AEF-2Nal-THP-K(Ac)-N-3Pya-Sar-$CONH_2$ | 1040 | 2 |
| 101 | MeCO-K(PEG2PEG2PgEC18OH)-Pen*-N-T-7MeW-K(Ac)-Pen*-AEF-2Nal-THP-K(Ac)-N-3Pya-Sar-$CONH_2$ | 961.1 | 25 |
| 102 | MeCO-K(PEG2PEG2pgEC18OH)-Pen*-N-T-7MeW-K(Ac)-Pen*-AEF-2Nal-THP-K(Ac)-N-3Pya-Sar-$CONH_2$ | 961.1 | 25 |
| 103 | MeCO-K(PEG2PEG2PPPgEC18OH)-Pen*-N-T-7MeW-K(Ac)-Pen*-AEF-2Nal-THP-K(Ac)-N-3Pya-Sar-$CONH_2$ | 1025.8 | 25 |
| 104 | MeCO-K(PEG2PEG2pppgEC18OH)-Pen*-N-T-7MeW-K(Ac)-Pen*-AEF-2Nal-THP-K(Ac)-N-3Pya-Sar-$CONH_2$ | 1025.9 | 25 |
| 105 | MeCO-Pen*-N-T-7MeW-K(Ac)-Pen*-AEF-2Nal-THP-K(PEG2PEG2PgEC18OH)-N-3Pya-Sar-$CONH_2$ | 1356.1 | 24 |
| 106 | MeCO-Pen*-N-T-7MeW-K(Ac)-Pen*-AEF-2Nal-THP-K(PEG2PEG2pgEC18OH)-N-3Pya-Sar-$CONH_2$ | 1356 | 24 |
| 107 | MeCO-Pen*-N-T-7MeW-K(Ac)-Pen*-AEF-2Nal-THP-K(PEG2PEG2PPPgEC18OH)-N-3Pya-Sar-$CONH_2$ | 1453.1 | 24 |
| 108 | MeCO-Pen*-N-T-7MeW-K(Ac)-Pen*-AEF-2Nal-THP-K(PEG2PEG2pppgEC18OH)-N-3Pya-Sar-$CONH_2$ | 1453 | 24 |
| 109 | MeCO-K(PEG2PEG2TrxgEC18OH)-Pen*-N-T-7MeW-K(Ac)-Pen*-AEF-2Nal-THP-K(Ac)-N-3Pya-Sar-$CONH_2$ | 1461.7 | 25 |

TABLE 3-continued

Compound Synthesis

| Example | Name | MS Data | Synthetic Procedure (Example) |
|---|---|---|---|
| 110 | MeCO-K(PEG2PEG2gEmXOH)-Pen*-N-T-7MeW-K(Ac)-Pen*-AEF-2Nal-THP-K(Ac)-N-3Pya-Sar-$CONH_2$ | 1389.5 | 25 |
| 111 | MeCO-Pen*-N-T-7MeW-K(Ac)-Pen*-AEF-2Nal-THP-K(PEG2PEG2gEpXOH)-N-3Pya-Sar-$CONH_2$ | 1304.5 | 24 |
| 112 | MeCO-K(PEG2PEG2gEpXOH)-Pen*-N-T-K(Ac)-Pen*-AEF-2Nal-THP-K(PEG2PEG2gEpXOH)-N-3Pya-Sar-$CONH_2$ | 1149.2 | 9 |
| 113 | MeCO-K(PEG2PEG2gEmXOH)-Pen*-N-T-7MeW-K(Ac)-Pen*-AEF-2Nal-THP-K(gEC16)-N-3Pya-Sar-$CONH_2$ | 1552.1 | 10 |
| 114 | MeCO-Pen*-N-T-7MeW-K(Ac)-Pen*-AEF-2Nal-THP-K(DAP-(C16OH)2)-N-3Pya-Sar-$CONH_2$ | 1260.7 | 15 |
| 115 | MeCO-K(DAP(C16OH)2)-Pen*-N-T-7MeW-K(Ac)-Pen*-AEF-2Nal-THP-K(Ac)-N-3Pya-Sar-$CONH_2$ | 1346 | 15 |
| 116 | MeCO-Pen*-N-T-7MeW-K(Ac)-Pen*-AEF-2Nal-THP-K(PEG2PEG2gE-DAP(C16OH)2)-N-3Pya-Sar-$CONH_2$ | 1470.3 | 15 |
| 117 | MeCO-K(PEG2PEG2gEDAP(C16OH)2)-Pen*-N-T-7MeW-K(Ac)-Pen*-AEF-2Nal-THP-K(Ac)-N-3Pya-Sar-$CONH_2$ | 1037.3 | 15 |
| 118 | MeCO-Pen*-N-T-7MeW-K(Ac)-Pen*-AEF-2Nal-THP-K(PEG2PEG2SP6gEC18OH)-N-3Pya-Sar-$CONH_2$ | 1371.2 | 7 |
| 119 | MeCO-Pen*-N-T-7MeW-K(Ac)-Pen*-AEF-2Nal-THP-K(PEG2SP6PEG2gEC18OH)-N-3Pya-Sar-$CONH_2$ | 1371 | 7 |
| 120 | MeCO-K(PEG2PEG2gEC16OH)-Pen*-N-T-7MeW-K(Ac)-Pen*-AEF-2Nal-THP-K(gEC18)-N-3Pya-Sar-$CONH_2$ | 1555.4 | 10 |
| 121 | MeCO-K(PEG2PEG2gEC18OH)-Pen*-N-T-7MeW-K(Ac)-Pen*-AEF-2Nal-THP-K(gEC18)-N-3Pya-Sar-$CONH_2$ | 1568.8 | 10 |
| 122 | MeCO-Pen*-K(PEG2PEG2gEC18OH)-T-7MeW-K(Ac)-Pen*-AEF-2Nal-THP-K(Ac)-N-3Pya-Sar-$CONH_2$ | 1335.2 | 2 |
| 123 | MeCO-Pen*-N-T-7MeW-K(Ac)-Pen*-AEF-2Nal-THP-K(PEG2PEG2 gE SP6 C18OH)-N-3Pya-Sar-$CONH_2$ | 1371.5 | 7 |
| 124 | MeCO-Pen*-N-T-7MeW-K(Ac)-Pen*-AEF-2Nal-THP-K(SP6 PEG2PEG2gE C18OH)-N-3Pya-Sar-$CONH_2$ | 1371 | 7 |
| 125 | MeCO-K(gEC16)-Pen*-N-T-7MeW-K(Ac)-Pen*-AEF-2Nal-THP-K(gEC18)-N-3Pya-Sar-$CONH_2$ | 1394.6 | 10 |
| 126 | MeCO-K(gEC18)-Pen*-N-T-7MeW-K(Ac)-Pen*-AEF-2Nal-THP-K(gEC18)-N-3Pya-Sar-$CONH_2$ | 1408.9 | 19 |
| 127 | MeCO-K(PEG2PEG2gEC10OH)-Pen*-N-T-7MeW-K(Ac)-Pen*-AEF-2Nal-THP-K(gEC18)-N-3Pya-Sar-$CONH_2$ | 1513.4 | 10 |
| 128 | MeCO-Pen*-N-T-7MeW-K(Ac)-Pen*-AEF-2Nal-THP-K(PEG2PEG2gETrxC20OH)-N-3Pya-Sar-$CONH_2$ | 1555.4 | 24 |
| 129 | MeCO-r-Pen*-N-T-7MeW-K(Ac)-Pen*-AEF-2Nal-THP-K(Ac)-N-3Pya-Sar-PEG2PEG2gDabC18OH-COOH | 1392.4 | 8 |
| 130 | MeCO-K(PEG2PEG2 gE SP6 C18OH)-Pen*-N-T-7MeW-K(Ac)-Pen*-AEF-2Nal-THP-K(Ac)-N-3Pya-Sar-$CONH_2$ | 1456.9 | 7 |
| 131 | MeCO-K(PEG2 SP6 PEG2 gE C18OH)-Pen*-N-T-7MeW-K(Ac)-Pen*-AEF-2Nal-THP-K(Ac)-N-3Pya-Sar-$CONH_2$ | 1456.55 | 7 |
| 132 | MeCO-K(SP6 PEG2PEG2gE C18OH)-Pen*-N-T-7MeW-K(Ac)-Pen*-AEF-2Nal-THP-K(Ac)-N-3Pya-Sar-$CONH_2$ | 1456.69 | 7 |
| 133 | MeCO-K[PEG2PEG2gEDAP(pXOH)2]-Pen*-N-T-7MeW-K(Ac)-Pen*-AEF-2Nal-THP-K(Ac)-N-3Pya-Sar-$CONH_2$ | 1578.4 | 15 |
| 134 | MeCO-Pen*-N-T-7MeW-K(Ac)-Pen*-AEF-2Nal-THP-K(PEG2PEG2gEDAP(mXOH)2)-N-3Pya-Sar-$CONH_2$ | 1492.9 | 15 |
| 135 | MeCO-K(GolAC16)-Pen*-N-T-7MeW-K(Ac)-Pen*-AEF-2Nal-THP-K(Ac)-N-3Pya-Sar-$CONH_2$ | 1212.8 | 25 |
| 136 | MeCO-K(GolAC16OH)-Pen*-N-T-7MeW-K(Ac)-Pen*-AEF-2Nal-THP-K(Ac)-N-3Pya-Sar-$CONH_2$ | 1228.3 | 25 |

TABLE 3-continued

| Compound Synthesis | | | |
|---|---|---|---|
| Example | Name | MS Data | Synthetic Procedure (Example) |
| 137 | MeCO-K(GolAC18OH)-Pen*-N-T-7MeW-K(Ac)-Pen*-AEF-2Nal-THP-K(Ac)-N-3Pya-Sar-$CONH_2$ | 1241.8 | 25 |
| 138 | MeCO-K(PEG2PEG2 GolAC18OH)-Pen*-N-T-7MeW-K(Ac)-Pen*-AEF-2Nal-THP-K(Ac)-N-3Pya-Sar-$CONH_2$ | 1386.55 | 25 |
| 139 | MeCO-K(PEG2PEG2 gE C18OH(c)-Pen*-N-T-7MeW-K(Ac)-Pen*-AEF-2Nal-THP-K(Ac)-N-3Pya-Sar-$CONH_2$ | 1463.76 | 25 |
| 140 | MeCO-K(PEG2PEG2C18GolB)-Pen*-N-T-7MeW-K(Ac)-Pen*-AEF-2Nal-THP-K(Ac)-N-3Pya-Sar-$CONH_2$ | 1365.2 | 25 |
| 141 | MeCO-K(PEG2PEG2 gE(C) C18OH-Pen*-N-T-7MeW-K(Ac)-Pen*-AEF-2Nal-THP-K(Ac)-N-3Pya-Sar-$CONH_2$ | 1463.9 | 16 |
| 142 | MeCO-K(PEG2PEG2 gE C18OH (C)-Pen*-N-T-7MeW-K(Ac)-Pen*-AEF-2Nal-THP-K(Ac)-N-3Pya-Sar-$CONH_2$ | 1463.69 | 25 |

Examples 201-492. Compounds

Additional compounds of the invention as shown in Table 4 below were prepared.

TABLE 4

| Compounds | |
|---|---|
| Example | Name |
| 201 | Ac-[Pen]-L-T-[Trp(7-Me)]-[Lys(PEG12__OMe)]-[Pen]-[Phe(4-OMe)]-[2Nal]-[aMeLeu]-L-N-[3Pal]-[Sarc]-NH2 |
| 202 | Ac-[Pen]-N-T-[Trp(7-Me)]-[Lys(PEG12__OMe)]-[Pen]-[Phe(4-OMe)]-[2Nal]-[aMeLeu]-L-N-[3Pal]-[Sarc]-NH2 |
| 203 | Ac-[Lys(PEG12__OMe)]-[Pen]-L-T-[Trp(7-Me)]-[Lys(Ac)]-[Pen]-[Phe(4-OMe)]-[2Nal]-[aMeLeu]-L-N-[3Pal]-[Sarc]-NH2 |
| 204 | Ac-[Lys(PEG12__OMe)]-[Pen]-N-T-[Trp(7-Me)]-[Lys(Ac)]-[Pen]-[Phe(4-OMe)]-[2Nal]-[aMeLeu]-L-N-[3Pal]-[Sarc]-NH2 |
| 205 | Ac-[Lys(PEG12__OMe)]-[Pen]-N-T-[Trp(7-Me)]-[Lys(Ac)]-[Pen]-F-[2Nal]-[aMeLeu]-L-N-[3Pal]-[Sarc]-NH2 |
| 206 | Ac-[Lys(PEG12__OMe)]-[Pen]-L-T-[Trp(7-Me)]-[Lys(Ac)]-[Pen]-F-[2Nal]-[aMeLeu]-L-N-[3Pal]-[Sarc]-NH2 |
| 207 | [PEG12__OMe]-[Pen]-N-T-[Trp(7-Me)]-[Lys(Ac)]-[Pen]-F-[2Nal]-[aMeLeu]-L-N-[3Pal]-[Sarc]-NH2 |
| 208 | Ac-[Pen]-N-T-[Trp(7-Me)]-[Lys(PEG12__OMe)]-[Pen]-F-[2Nal]-[aMeLeu]-L-N-[3Pal]-[Sarc]-NH2 |
| 209 | [PEG12__OMe]-[Pen]-L-T-[Trp(7-Me)]-[Lys(Ac)]-[Pen]-F-[2Nal]-[aMeLeu]-L-N-[3Pal]-[Sarc]-NH2 |
| 210 | Ac-[Pen]-L-T-[Trp(7-Me)]-[Lys(PEG12__OMe)]-[Pen]-F-[2Nal]-[aMeLeu]-L-N-[3Pal]-[Sarc]-NH2 |
| 211 | [PEG4__OMe]-[Pen]-N-T-[Trp(7-Me)]-[Lys(Ac)]-[Pen]-F-[2Nal]-[aMeLeu]-L-N-[3Pal]-[Sarc]-NH2 |
| 212 | Ac-[Pen]-N-T-[Trp(7-Me)]-[Lys(PEG4)]-[Pen]-F-[2Nal]-[aMeLeu]-L-N-[3Pal]-[Sarc]-NH2 |
| 213 | [PEG4__OMe]-[Pen]-L-T-[Trp(7-Me)]-[Lys(Ac)]-[Pen]-F-[2Nal]-[aMeLeu]-L-N-[3Pal]-[Sarc]-NH2 |
| 214 | Ac-[Pen]-L-T-[Trp(7-Me)]-[Lys(PEG4)]-[Pen]-F-[2Nal]-[aMeLeu]-L-N-[3Pal]-[Sarc]-NH2 |
| 215 | Ac-[Lys(PEG4)]-[Pen]-N-T-[Trp(7-Me)]-[Lys(Ac)]-[Pen]-F-[2Nal]-[aMeLeu]-L-N-[3Pal]-[Sarc]-NH2 |
| 216 | Ac-[Lys(PEG4)]-[Pen]-L-T-[Trp(7-Me)]-[Lys(Ac)]-[Pen]-F-[2Nal]-[aMeLeu]-L-N-[3Pal]-[Sarc]-NH2 |
| 217 | Ac-[Pen]-N-T-[Trp(7-Me)]-[Lys(Ac)]-[Pen]-[Phe(4-OMe)]-[2Nal]-[aMeLys(PEG12__IsoGlu__Palm)]-E-L-[3Pal]-[Sarc]-NH2 |
| 218 | Ac-[Pen]-N-T-[Trp(7-Me)]-[Lys(Ac)]-[Pen]-[Phe(4-OMe)]-[2Nal]-[aMeLys(PEG12__IsoGlu__Palm)]-[Lys(Ac)]-L-[3Pal]-[Sarc]-NH2 |
| 219 | Ac-[Pen]-N-T-[Trp(7-Me)]-[Lys(Ac)]-[Pen]-[2Nal]-[2Nal]-[aMeLys(PEG12__IsoGlu__Palm)]-E-L-[3Pal]-[Sarc]-NH2 |
| 220 | Ac-[Pen]-N-T-[Trp(7-Me)]-[Lys(Ac)]-[Pen]-[2Nal]-[2Nal]-[aMeLys(PEG12__IsoGlu__Palm)]-[Lys(Ac)]-L-[3Pal]-[Sarc]-NH2 |
| 221 | Ac-[Pen]-N-T-[Trp(7-Me)]-[Lys(Ac)]-[Pen]-F-[2Nal]-[aMeLys(PEG12__IsoGlu__Palm)]-L-L-[3Pal]-[Sarc]-NH2 |

TABLE 4-continued

| Compounds | |
|---|---|
| Example | Name |
| 222 | Ac-[Pen]-N-T-[Trp(7-Me)]-[Lys(Ac)]-[Pen]-F-[2Nal]-[aMeLys(PEG12__IsoGlu__Palm)]-E-L-[3Pal]-[Sarc]-NH2 |
| 223 | Ac-[Pen]-A-T-[Trp(7-Me)]-[Lys(Ac)]-[Pen]-[Phe(4-OMe)]-[2Nal]-[aMeLys(PEG12__IsoGlu__Palm)]-A-A-[3Pal]-[Sarc]-NH2 |
| 224 | Ac-[Pen]-A-T-[Trp(7-Me)]-[Lys(Ac)]-[Pen]-[Phe(4-OMe)]-[2Nal]-[aMeLys(PEG12__IsoGlu__C18__Diacid)]-A-A-[3Pal]-[Sarc]-NH2 |
| 225 | Ac-[Pen]-L-T-[Trp(7-Me)]-[Lys(PEG12__OMe)]-[Pen]-[Phe(4-OMe)]-[2Nal]-[aMeLeu]-L-N-[3Pal]-[Sarc]-NH2 |
| 226 | Ac-[Pen]-N-T-[Trp(7-Me)]-[Lys(Ac)]-[Pen]-[Phe(4-OMe)]-[2Nal]-[aMeLys(PEG12__IsoGlu__Palm)]-A-A-[3Pal]-[Sarc]-NH2 |
| 227 | Ac-[Pen]-A-T-[Trp(7-Me)]-[Lys(Ac)]-[Pen]-[Phe(4-OMe)]-[2Nal]-[aMeLys(PEG12__IsoGlu__Palm)]-[Lys(Ac)]-N-[3Pal]-[Sarc]-NH2 |
| 228 | Ac-[Pen]-A-T-[Trp(7-Me)]-[Lys(Ac)]-[Pen]-[Phe(4-OMe)]-[2Nal]-[aMeLys(PEG12__IsoGlu__C18__Diacid)]-[Lys(Ac)]-N-[3Pal]-[Sarc]-NH2 |
| 229 | Ac-[Pen]-N-T-[Trp(7-Me)]-[Lys(Ac)]-[Pen]-[Phe(4-(2-(1PEG2__1PEG2__IsoGlu__Palm)aminoethoxy))]-[2Nal]-[THP]-[Lys(Ac)]-L-[3Pal]-[Sarc]-NH2 |
| 230 | Ac-[Pen]-N-T-[Trp(7-Me)]-[Lys(Ac)]-[Pen]-[Phe(4-(2-(1PEG2__1PEG2__IsoGlu__C18__Diacid)aminoethoxy))]-[2Nal]-[THP]-[Lys(Ac)]-L-[3Pal]-[Sarc]-NH2 |
| 231 | Ac-[Pen]-N-T-[Trp(7-Me)]-[Lys(Ac)]-[Pen]-[Phe(4-(2-(PEG4__PEG4__IsoGlu__Palm)aminoethoxy))]-[2Nal]-[THP]-[Lys(Ac)]-L-[3Pal]-[Sarc]-NH2 |
| 232 | Ac-[Pen]-N-T-[Trp(7-Me)]-[Lys(Ac)]-[Pen]-[Phe(4-(2-(PEG12__IsoGlu__Palm)aminoethoxy))]-[2Nal]-[THP]-[Lys(Ac)]-L-[3Pal]-[Sarc]-NH2 |
| 233 | Ac-[Pen]-N-T-[Trp(7-Me)]-[Lys(Ac)]-[Pen]-[Phe(4-OMe)]-[2Nal]-[Lys(PEG12__IsoGlu__Palm)]-[Lys(Ac)]-N-[3Pal]-[Sarc]-NH2 |
| 234 | Ac-[Pen]-N-T-[Trp(7-Me)]-[Lys(Ac)]-[Pen]-F-[2Nal]-[Spiral__Pip__PEG12__IsoGlu__Palm]-[Lys(Ac)]-N-[3Pal]-[Sarc]-NH2 |
| 235 | Ac-[Pen]-N-T-[Trp(7-Me)]-[Lys(Ac)]-[Pen]-F-[2Nal]-[aMeLys(PEG12__IsoGlu__Palm)]-[Lys(Ac)]-L-[3Pal]-[Sarc]-NH2 |
| 236 | Ac-[Pen]-N-T-[Trp(7-Me)]-[Lys(Ac)]-[Pen]-[Phe(4-OMe)]-[2Nal]-[aMeLys(PEG12__IsoGlu__C18__Diacid)]-A-A-[3Pal]-[Sarc]-NH2 |
| 237 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12__C18__Diacid)]-NH2 |
| 238 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12__IsoGlu__Palm)]-NH2 |
| 239 | Ac-[Pen]-L-T-[Trp(7-Me)]-[Lys(Ac)]-[Pen]-[Phe(4-OMe)]-[2Nal]-[THP]-[Lys(Ac)]-L-[3Pal]-[(D)Lys(PEG12__IsoGlu__C18__Diacid)]-NH2 |
| 240 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12__C18__Diacid)]-[3Pal]-[Sarc]-NH2 |
| 241 | Ac-[Pen]-A-T-[Trp(7-Me)]-[Lys(Ac)]-[Pen]-[Phe(4-OMe)]-[2Nal]-[aMeLys(PEG12__IsoGlu__Palm)]-[Lys(Ac)]-A-[3Pal]-[Sarc]-NH2 |
| 242 | Ac-[Pen]-A-T-[Trp(7-Me)]-[Lys(Ac)]-[Pen]-[Phe(4-OMe)]-[2Nal]-[aMeLys(PEG12__IsoGlu__C18__Diacid)]-[Lys(Ac)]-A-[3Pal]-[Sarc]-NH2 |
| 243 | Ac-[Pen]-L-T-[Trp(7-Me)]-[Lys(Ac)]-[Pen]-[Phe(4-OMe)]-[2Nal]-[THP]-[Lys(PEG12__C18__Diacid)]-L-[3Pal]-[Sarc]-NH2 |
| 244 | Ac-[Pen]-L-T-[Trp(7-Me)]-[Lys(Ac)]-[Pen]-[Phe(4-OMe)]-[2Nal]-[THP]-[Lys(PEG12__IsoGlu__Palm)]-L-[3Pal]-[Sarc]-NH2 |
| 245 | Ac-[Pen]-L-T-[Trp(7-Me)]-[Lys(Ac)]-[Pen]-[Phe(4-OMe)]-[2Nal]-[THP]-[Lys(PEG12__IsoGlu__C18__Diacid)]-L-[3Pal]-[Sarc]-NH2 |
| 246 | Ac-[Pen]-L-[Lys(PEG12__C18__Diacid)]-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 247 | Ac-[Pen]-L-[Lys(PEG12__IsoGlu__Palm)]-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 248 | Ac-[Pen]-L-[Lys(PEG12__IsoGlu__C18__Diacid)]-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 249 | Ac-[Pen]-N-T-[Trp(7-Me)]-[Lys(Ac)]-[Pen]-[Phe(4-OMe)]-[2Nal]-[aMeLys(PEG12__IsoGlu__Palm)]-[Lys(Ac)]-A-[3Pal]-[Sarc]-NH2 |
| 250 | Ac-[Pen]-[Lys(PEG12__IsoGlu__Palm)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 251 | Ac-[Pen]-[Lys(PEG12__IsoGlu__C18__Diacid)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 252 | [Pen(PEG4__Ahx__C18__Diacid)]-N-T-[Trp(7-Me)]-[Lys(Ac)]-[Pen]-[Phe(4-OMe)]-[2Nal]-[THP]-E-L-[3Pal]-[Sarc]-NH2 |
| 253 | [Pen(PEG4__IsoGlu__C18__Diacid)]-N-T-[Trp(7-Me)]-[Lys(Ac)]-[Pen]-[Phe(4-OMe)]-[2Nal]-[THP]-E-L-[3Pal]-[Sarc]-NH2 |
| 254 | Ac-[(D)Lys(PEG12__IsoGlu__Palm)]-[Pen]-L-T-[Trp(7-Me)]-[Lys(Ac)]-[Pen]-[Phe(4-OMe)]-[2Nal]-[THP]-L-L-[3Pal]-[Sarc]-NH2 |
| 255 | Ac-[(D)Lys(PEG12__IsoGlu__C18__Diacid)]-[Pen]-L-T-[Trp(7-Me)]-[Lys(Ac)]-[Pen]-[Phe(4-OMe)]-[2Nal]-[THP]-L-L-[3Pal]-[Sarc]-NH2 |
| 256 | Ac-[(D)Lys(PEG12__C18__Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 257 | Ac-[(D)Lys(Peg4__C18__Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |

TABLE 4-continued

| Compounds | |
|---|---|
| Example | Name |
| 258 | Ac-[(D)Lys(IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 259 | Ac-[(D)Lys(Peg4_IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 260 | Ac-[(D)Lys(PEG12_IsoGlu_Palm)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 261 | Ac-[(D)Lys(PEG12_IsoGlu_C18_Diacid)]-[Pen]-L-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 262 | Ac-[Pen]-L-T-[Trp(7-Me)]-[Lys(PEG12_C18_Diacid)]-[Pen]-[Phe(4-OMe)]-[2Nal]-[THP]-L-L-[3Pal]-[Sarc]-NH2 |
| 263 | Ac-[Pen]-L-T-[Trp(7-Me)]-[Lys(PEG4_C18_Diacid)]-[Pen]-[Phe(4-OMe)]-[2Nal]-[THP]-L-L-[3Pal]-[Sarc]-NH2 |
| 264 | Ac-[Pen]-L-T-[Trp(7-Me)]-[Lys(IsoGlu_C18_Diacid)]-[Pen]-[Phe(4-OMe)]-[2Nal]-[THP]-L-L-[3Pal]-[Sarc]-NH2 |
| 265 | Ac-[Pen]-L-T-[Trp(7-Me)]-[Lys(IsoGlu_Palm)]-[Pen]-[Phe(4-OMe)]-[2Nal]-[THP]-L-L-[3Pal]-[Sarc]-NH2 |
| 266 | Ac-[Pen]-L-T-[Trp(7-Me)]-[Lys(PEG4_IsoGlu_Palm)]-[Pen]-[Phe(4-OMe)]-[2Nal]-[THP]-L-L-[3Pal]-[Sarc]-NH2 |
| 267 | Ac-[Pen]-L-T-[Trp(7-Me)]-[Lys(PEG4_IsoGlu_C18_Diacid)]-[Pen]-[Phe(4-OMe)]-[2Nal]-[THP]-L-L-[3Pal]-[Sarc]-NH2 |
| 268 | Ac-[Pen]-L-T-[Trp(7-Me)]-[Lys(PEG12_IsoGlu_Palm)]-[Pen]-[Phe(4-OMe)]-[2Nal]-[THP]-L-L-[3Pal]-[Sarc]-NH2 |
| 269 | Ac-[Pen]-L-T-[Trp(7-Me)]-[Lys(PEG12_IsoGlu_C18_Diacid)]-[Pen]-[Phe(4-OMe)]-[2Nal]-[THP]-L-L-[3Pal]-[Sarc]-NH2 |
| 270 | Ac-[Pen]-L-T-[Trp(7-Me)]-[Lys(PEG12_C18_Diacid)]-[Pen]-[Phe(4-OMe)]-[2Nal]-[THP]-[Lys(Ac)]-L-[3Pal]-[Sarc]-NH2 |
| 271 | Ac-[Pen]-L-T-[Trp(7-Me)]-[Lys(PEG4_C18_Diacid)]-[Pen]-[Phe(4-OMe)]-[2Nal]-[THP]-[Lys(Ac)]-L-[3Pal]-[Sarc]-NH2 |
| 272 | Ac-[Pen]-L-T-[Trp(7-Me)]-[Lys(IsoGlu_C18_Diacid)]-[Pen]-[Phe(4-OMe)]-[2Nal]-[THP]-[Lys(Ac)]-L-[3Pal]-[Sarc]-NH2 |
| 273 | Ac-[Pen]-L-T-[Trp(7-Me)]-[Lys(IsoGlu_Palm)]-[Pen]-[Phe(4-OMe)]-[2Nal]-[THP]-[Lys(Ac)]-L-[3Pal]-[Sarc]-NH2 |
| 274 | Ac-[Pen]-L-T-[Trp(7-Me)]-[Lys(PEG4_IsoGlu_Palm)]-[Pen]-[Phe(4-OMe)]-[2Nal]-[THP]-[Lys(Ac)]-L-[3Pal]-[Sarc]-NH2 |
| 275 | Ac-[Pen]-L-T-[Trp(7-Me)]-[Lys(PEG4_IsoGlu_C18_Diacid)]-[Pen]-[Phe(4-OMe)]-[2Nal]-[THP]-[Lys(Ac)]-L-[3Pal]-[Sarc]-NH2 |
| 276 | Ac-[Pen]-L-T-[Trp(7-Me)]-[Lys(PEG12_IsoGlu_Palm)]-[Pen]-[Phe(4-OMe)]-[2Nal]-[THP]-[Lys(Ac)]-L-[3Pal]-[Sarc]-NH2 |
| 277 | Ac-[Pen]-L-T-[Trp(7-Me)]-[Lys(PEG12_IsoGlu_C18_Diacid)]-[Pen]-[Phe(4-OMe)]-[2Nal]-[THP]-[Lys(Ac)]-L-[3Pal]-[Sarc]-NH2 |
| 278 | Ac-[Pen]-N-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-A-[3Pal]-[Sarc]-NH2 |
| 279 | Ac-[Pen]-N-T-[Trp(7-Me)]-[Lys(Ac)]-[Pen]-[Phe(4-(2-(PEG4_PEG4_IsoGlu_C18_Diacid)aminoethoxy))]-[2Nal]-[THP]-[Lys(Ac)]-L-[3Pal]-[Sarc]-NH2 |
| 280 | Ac-[Pen]-N-T-[Trp(7-Me)]-[Lys(Ac)]-[Pen]-[Phe(4-(2-(PEG12_IsoGlu_C18_Diacid)aminoethoxy))]-[2Nal]-[THP]-[Lys(Ac)]-L-[3Pal]-[Sarc]-NH2 |
| 281 | Ac-[Pen]-N-T-[Trp(7-Me)]-[Lys(Ac)]-[Pen]-[Phe(4-OMe)]-[2Nal]-[Lys(PEG12_IsoGlu_C18_Diacid)]-[Lys(Ac)]-N-[3Pal]-[Sarc]-NH2 |
| 282 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12_IsoGlu_C18_Diacid)]-[3Pal]-[Sarc]-NH2 |
| 283 | Ac-[Pen]-[Lys(PEG12_C18_Diacid)]-T-[Trp(7-Me)]-[Lys(Ac)]-[Pen]-[Phe(4-OMe)]-[2Nal]-[THP]-[Lys(Ac)]-L-[3Pal]-[Sarc]-NH2 |
| 284 | [PEG4_Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 285 | [PEG4_Lauryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 286 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12_IsoGlu_C18_Diacid)]-NH2 |
| 287 | [PEG4_Capryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 288 | [PEG4_Hexyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 289 | [PEG2_Palm]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 290 | [PEG2_Myristyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 291 | [PEG2_Lauryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 292 | [Hexyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 293 | [Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 294 | [PEG2_Decyl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |

TABLE 4-continued

| Compounds | |
|---|---|
| Example | Name |
| 295 | [PEG2__Capryl]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 296 | [Oct]-[Pen]-N-T-[Trp(7-Me)]-[Lys(Ac)]-[Pen]-[Phe(4-OMe)]-[2Nal]-[THP]-L-N-[3Pal]-[Sarc]-NH2 |
| 297 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4__IsoGlu__Palm)]-NH2 |
| 298 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(IsoGlu__Palm)]-NH2 |
| 299 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12__C18__Diacid)]-NH2 |
| 300 | Ac-[Pen]-N-T-[Trp(7-Me)]-[Lys(Ac)]-[Pen]-[Phe(4-CONH2)]-[2Nal]-[aMeLys(Peg4__IsoGlu__C18__Diacid)]-[Lys(Ac)]-N-[3Pal]-[Sarc]-NH2 |
| 301 | Ac-[Pen]-N-T-[Trp(7-Me)]-[Lys(Ac)]-[Pen]-[Phe(4-CONH2)]-[2Nal]-[aMeLys(PEG12__C18__Diacid)]-[Lys(Ac)]-N-[3Pal]-[Sarc]-NH2 |
| 302 | Ac-[Pen]-L-T-[Trp(7-Me)]-[Lys(Ac)]-[Pen]-[Phe(4-OMe)]-[2Nal]-[THP]-[Lys(Ac)]-[Lys(PEG12__IsoGlu__Palm)]-[3Pal]-[Sarc]-NH2 |
| 303 | [PEG2__Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 304 | [PEG2__Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 305 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4__IsoGlu__C18__Diacid)]-NH2 |
| 306 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(PEG12__IsoGlu__Palm)]-NH2 |
| 307 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(Peg4__C18__Diacid)]-NH2 |
| 308 | Ac-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[(D)Lys(IsoGlu__C18__Diacid)]-NH2 |
| 309 | [PEG4__Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 310 | [Palm]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 311 | [Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 312 | [Oct]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 313 | [PEG4__Lauryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 314 | [PEG4__Capryl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 315 | [PEG4__Hexyl]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 316 | Ac-[Pen]-N-T-[Trp(7-Me)]-[Lys(Ac)]-[Pen]-[Phe(4-CONH2)]-[2Nal]-[aMeLys(PEG12__IsoGlu__C18__Diacid)]-[Lys(Ac)]-N-[3Pal]-[Sarc]-NH2 |
| 317 | Ac-[Pen]-N-T-[Trp(7-Me)]-[Lys(Ac)]-[Pen]-[Phe(4-CONH2)]-[2Nal]-[aMeLys(PEG12__IsoGlu__Palm)]-[Lys(Ac)]-N-[3Pal]-[Sarc]-NH2 |
| 318 | Ac-[Pen]-N-T-[Trp(7-Me)]-[Lys(Ac)]-[Pen]-[Phe(4-CONH2)]-[2Nal]-[aMeLys(Peg4__IsoGlu__Palm)]-[Lys(Ac)]-N-[3Pal]-[Sarc]-NH2 |
| 319 | Ac-[Pen]-N-T-[Trp(7-Me)]-[Lys(Ac)]-[Pen]-[Phe(4-CONH2)]-[2Nal]-[aMeLys(IsoGlu__Palm)]-[Lys(Ac)]-N-[3Pal]-[Sarc]-NH2 |
| 320 | Ac-[Pen]-N-T-[Trp(7-Me)]-[Lys(Ac)]-[Pen]-[Phe(4-CONH2)]-[2Nal]-[aMeLys(IsoGlu__C18__Diacid)]-[Lys(Ac)]-N-[3Pal]-[Sarc]-NH2 |
| 321 | Ac-[Pen]-N-T-[Trp(7-Me)]-[Lys(Ac)]-[Pen]-[Phe(4-CONH2)]-[2Nal]-[aMeLys(Peg4__C18__Diacid)]-[Lys(Ac)]-N-[3Pal]-[Sarc]-NH2 |
| 322 | [1PEG2__1PEG2__IsoGlu__C16__Diacid)]-[(D)Arg]-[Pen]-N-T-[Trp(7-Me)]-[Lys(Ac)]-[Pen]-[Phe(4-(2-aminoethoxy))]-[2Nal]-[THP]-[Lys(Ac)]-N-[3Pal]-[Sarc]-NH2 |
| 323 | [1PEG2__1PEG2__IsoGlu__C18__Diacid)]-[(D)Arg]-[Pen]-N-T-[Trp(7-Me)]-[Lys(Ac)]-[Pen]-[Phe(4-(2-aminoethoxy))]-[2Nal]-[THP]-[Lys(Ac)]-N-[3Pal]-[Sarc]-NH2 |
| 324 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Lys(1PEG2__1PEG2__IsoGlu__C16__Diacid)]-NH2 |
| 325 | Ac-[(D)Arg]-[Pen]-[Lys(1PEG2__1PEG2__IsoGlu__C16__Diacid)]-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 326 | Ac-[(D)Arg]-[Pen]-[Lys(1PEG2__1PEG2__IsoGlu__C18__Diacid)]-T-[Trp(7-Me)]-[Lys(Ac)]-[Pen]-[Phe(4-(2-aminoethoxy))]-[2Nal]-[THP]-E-N-[3Pal]-[Sarc]-NH2 |
| 327 | Ac-[Pen]-N-T-[Trp(7-Me)]-[Lys(Ac)]-[Pen]-[Phe(4-(2-aminoethoxy))]-[2Nal]-[THP]-[Lys(1PEG2__1PEG2__IsoGlu__C16__Diacid)]-N-[3Pal]-[Sarc]-NH2 |
| 328 | Ac-[Pen]-N-T-[Trp(7-Me)]-[Lys(Ac)]-[Pen]-[Phe(4-(2-aminoethoxy))]-[2Nal]-[THP]-[Lys(1PEG2__1PEG2__IsoGlu__C18__Diacid)]-N-[3Pal]-[Sarc]-NH2 |
| 329 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Lys(1PEG2__1PEG2__IsoGlu__C18__Diacid)]-NH2 |

TABLE 4-continued

| Compounds | |
|---|---|
| Example | Name |
| 330 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[Lys(1PEG2_1PEG2_IsoGlu_C16_Diacid)]-NH2 |
| 331 | Ac-[(D)Arg]-[Pen]-N-T-[Trp(7-Me)]-[Lys(Ac)]-[Pen]-[Phe(4-(2-aminoethoxy))]-[2Nal]-[THP]-E-N-[3Pal]-[Sarc]-[Lys(1PEG2_1PEG2_IsoGlu_C18_Diacid)]-NH2 |
| 332 | [1PEG2_1PEG2_IsoGlu_C18]-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-NH2 |
| 333 | [1PEG2_1PEG2_IsoGlu_C18_Diacid]-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-NH2 |
| 334 | Ac-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-[Lys(1PEG2_1PEG2_IsoGlu_C18_Diacid)]-NH2 |
| 335 | Ac-[(D)Lys(1PEG2_1PEG2_IsoGlu_C18_Diacid)]-[Pen]-N-T-[Trp(7-Me)]-[Lys(Ac)]-[Pen]-[Phe(4-(2-aminoethoxy))]-[2Nal]-[Acvc]-E-N-[THP]-NH2 |
| 336 | Ac-[(D)Lys(1PEG2_1PEG2_IsoGlu_C16_Diacid)]-[Pen]-N-T-[Trp(7-Me)]-[Lys(Ac)]-[Pen]-[Phe(4-(2-aminoethoxy))]-[2Nal]-[Acvc]-E-N-[THP]-NH2 |
| 337 | Ac-[(D)Arg]-[Pen]-N-T-[Trp(7-Me)]-[Lys(Ac)]-[Pen]-[Phe(4-(2-aminoethoxy))]-[2Nal]-[Acvc]-E-N-[THP]-[Lys(1PEG2_1PEG2_IsoGlu_C18)]-NH2 |
| 338 | Ac-[Pen]-N-T-[Trp(7-Me)]-[Lys(Ac)]-[Pen]-[Phe(4-(2-aminoethoxy))]-[3Quin]-[THP]-E-N-H-[Sarc]-NH2-[PEG4] |
| 339 | Ac-[Pen]-N-T-[Trp(7-Me)]-[Lys(Ac)]-[Pen]-[Phe(4-OMe)]-[2Nal]-[aMeLys(PEG12_IsoGlu_C18_Diacid)]-[Lys(Ac)]-N-[3Pal]-[Sarc]-NH2 |
| 340 | Ac-[Pen]-N-T-[Trp(7-Me)]-[Lys(Ac)]-[Pen]-[Phe(4-OMe)]-[2Nal]-[aMeLys(PEG12_IsoGlu_Palm)]-[Lys(Ac)]-N-[3Pal]-[Sarc]-NH2 |
| 341 | [PEG12_OMe]-[Pen]-L-T-[Trp(7-Me)]-[Lys(Ac)]-[Pen]-F-[Nal]-[aMeLeu]-L-N-[NH(2-(pyridin-3-yl)ethyl)] |
| 342 | Ac-[Pen]-L-T-[Trp(7-Me)]-[Lys(PEG12_OMe)]-[Pen]-F-[Nal]-[aMeLeu]-L-N-[NH(2-(pyridin-3-yl)ethyl)] |
| 343 | [PEG12_OMe]-[Pen]-L-T-[Trp(7-Me)]-[Lys(Ac)]-[Pen]-[Phe(4-OMe)]-[Nal]-[aMeLeu]-L-N-[NH(2-(pyridin-3-yl)ethyl)] |
| 344 | Ac-[Pen]-L-T-[Trp(7-Me)]-[Lys(PEG12_OMe)]-[Pen]-[Phe(4-OMe)]-[Nal]-[aMeLeu]-L-N-[NH(2-(pyridin-3-yl)ethyl)] |
| 345 | [PEG12_OMe]-[Pen]-[aMeAsn]-T-[Trp(7-Me)]-[Lys(Ac)]-[Pen]-F-[Nal]-[aMeLeu]-L-N-[NH(2-(pyridin-3-yl)ethyl)] |
| 346 | Ac-[Pen]-[aMeAsn]-T-[Trp(7-Me)]-[Lys(PEG12_OMe)]-[Pen]-F-[Nal]-[aMeLeu]-L-N-[NH(2-(pyridin-3-yl)ethyl)] |
| 347 | [PEG12_OMe]-[Pen]-[aMeAsn]-T-[Trp(7-Me)]-[Lys(Ac)]-[Pen]-[Phe(4-OMe)]-[Nal]-[aMeLeu]-L-N-[NH(2-(pyridin-3-yl)ethyl)] |

Example 348. Biological Assays

IL-23 binding to IL-23 receptors results in the activation of the Signal Transducer and Activator of Transcription 3 (STAT3) by phosphorylation and downstream signaling events. Accordingly. the ability of the inhibitors described herein to block IL-23 action can be assessed by monitoring the status of STAT3 activation in response to IL-23. This may be accomplished in reporter cell assays or in intact cells such as peripheral blood mononuclear cells (PBMCs).

IL23R Reporter Assay

Compounds were serially diluted in 100% (v/v) DMSO) and plated using an Echo acoustic dispenser (Labcyte) into 1536-well non-treated black assay plates (Corning #9146). 3 L of HEK293 cells containing IL-23R, IL-12RP31 and a firefly luciferase reporter gene driven by a STAT-inducible promoter (Promega) were added to the plates (4000 cells/well), followed by 3 μL of 10 ng/mL IL-23 (equivalent to $EC_{90}$ concentration). After 5 h at 37° C., 5% $CO_2$, 95% relative humidity, cells were placed at 20° C. and treated with BioGlo reagent (Promega) according to the Manufacturer's instructions. Luminescence was measured on a Pherastar FSX (BMG LabTech). The data, provided in Tables 5a and 5b, were normalized to IL-23 treatment (0% inhibition) and 30 μM of control inhibitor (100% inhibition), and $IC_{50}$ values were determined using a 4-parameter Hill equation.

TABLE 5a

| IL-23 Binding Data for the Compounds of Examples 2 to 347. | |
|---|---|
| Example | IC50 (nM) |
| 2 | 0.086 |
| 3 | 0.023 |
| 4 | 0.066 |
| 5 | 0.021 |
| 6 | 0.055 |
| 7 | 0.024 |
| 8 | 0.089 |
| 9 | 0.035 |
| 10 | 1.88 |
| 11 | 0.044 |
| 12 | 0.29 |
| 13 | 0.064 |
| 14 | 0.2 |
| 15 | 0.054 |
| 16 | 0.014 |
| 17 | 0.036 |
| 18 | 0.12 |
| 19 | 0.037 |
| 20 | 0.067 |
| 21 | 0.033 |
| 22 | 0.026 |
| 23 | 0.12 |
| 24 | 0.017 |
| 25 | 0.0078 |
| 26 | 0.025 |
| 27 | 0.059 |

TABLE 5a-continued

IL-23 Binding Data for the Compounds of Examples 2 to 347.

| Example | IC50 (nM) |
|---|---|
| 28 | 0.021 |
| 29 | 0.06 |
| 30 | 0.17 |
| 31 | 0.052 |
| 32 | 0.021 |
| 33 | 0.046 |
| 34 | 0.065 |
| 35 | 0.19 |
| 36 | 0.14 |
| 37 | 0.19 |
| 38 | 0.021 |
| 39 | 0.048 |
| 40 | 0.023 |
| 41 | 0.078 |
| 42 | 0.029 |
| 43 | 0.049 |
| 44 | 0.02 |
| 45 | 0.039 |
| 46 | 0.26 |
| 47 | 0.041 |
| 48 | 0.045 |
| 49 | 0.046 |
| 50 | 0.1 |
| 51 | 0.18 |
| 52 | 0.15 |
| 53 | |
| 54 | 0.13 |
| 55 | 0.13 |
| 56 | 0.17 |
| 57 | 0.3 |
| 58 | 0.094 |
| 59 | 0.18 |
| 60 | 0.042 |
| 61 | 0.044 |
| 62 | 0.054 |
| 63 | 0.13 |
| 64 | 0.055 |
| 65 | 0.19 |
| 66 | 0.18 |
| 67 | 0.035 |
| 68 | 0.037 |
| 69 | 0.13 |
| 70 | 0.23 |
| 71 | 0.081 |
| 72 | 0.11 |
| 73 | 0.094 |
| 74 | 0.17 |
| 75 | 0.096 |
| 76 | 0.18 |
| 77 | 0.3 |
| 78 | 0.23 |
| 79 | 0.38 |
| 80 | >16.61 |
| 81 | 0.012 |
| 82 | 0.013 |
| 83 | 0.052 |
| 84 | 0.046 |
| 85 | 0.031 |
| 86 | 0.061 |
| 87 | 0.079 |
| 88 | 0.2 |
| 89 | 0.34 |
| 90 | 0.12 |
| 91 | |
| 92 | 0.18 |
| 93 | 0.12 |
| 94 | 1.44 |
| 95 | 0.14 |
| 96 | 0.13 |
| 97 | 0.0082 |
| 98 | 1.24 |
| 99 | 0.096 |
| 100 | 0.11 |
| 101 | 0.066 |
| 102 | 0.053 |
| 103 | 0.066 |
| 104 | 0.066 |
| 105 | 0.089 |
| 106 | 0.11 |
| 107 | 0.09 |
| 108 | 0.15 |
| 109 | 0.056 |
| 110 | 0.0096 |
| 111 | 0.048 |
| 112 | 0.018 |
| 113 | 1.11 |
| 114 | 0.15 |
| 115 | 0.082 |
| 116 | 0.15 |
| 117 | 0.1 |
| 118 | 0.077 |
| 119 | 0.058 |
| 120 | 0.38 |
| 121 | 0.9 |
| 122 | 0.083 |
| 123 | 0.073 |
| 124 | 0.083 |
| 125 | 0.075 |
| 126 | 0.16 |
| 127 | 0.17 |
| 128 | 0.1 |
| 129 | 0.24 |
| 130 | 0.02 |
| 131 | 0.021 |
| 132 | 0.031 |
| 133 | 0.031 |
| 134 | 0.037 |
| 135 | 0.016 |
| 136 | 0.016 |
| 137 | 0.024 |
| 138 | 0.039 |
| 139 | 0.0079 |
| 140 | 0.012 |
| 141 | 0.011 |
| 142 | 0.0092 |

TABLE 5b

IL-23 Binding Data for the Compounds of Examples 348 to 492.

| Compound/ Example No. | $IC_{50}$ (μM) |
|---|---|
| 348 | 0.94 |
| 349 | 0.98 |
| 350 | 0.7 |
| 351 | |
| 352 | |
| 353 | 0.37 |
| 354 | 1.28 |
| 355 | 8.38 |
| 356 | 3.26 |
| 357 | 8.51 |
| 358 | 2.74 |
| 359 | 0.12 |
| 360 | 0.0075 |
| 361 | 0.0051 |
| 362 | 0.056 |
| 363 | 0.25 |
| 364 | 0.1 |
| 365 | 0.0052 |
| 366 | 0.0092 |
| 367 | 0.006 |
| 368 | 0.056 |
| 371 | 0.014 |
| 372 | 0.039 |
| 373 | 0.041 |
| 374 | 0.041 |
| 378 | 0.016 |

TABLE 5b-continued

IL-23 Binding Data for the Compounds of Examples 348 to 492.

| Compound/ Example No. | $IC_{50}$ (μM) |
|---|---|
| 380 | 0.039 |
| 381 | 0.0076 |
| 382 | 0.0035 |
| 383 | 0.0045 |
| 384 | 0.0086 |
| 385 | 0.016 |
| 386 | 0.12 |
| 392 | 0.037 |
| 396 | 0.1 |
| 397 | 0.071 |
| 398 | 0.067 |
| 399 | 0.06 |
| 400 | 0.048 |
| 401 | 0.044 |
| 402 | 0.017 |
| 403 | 0.076 |
| 404 | |
| 405 | |
| 406 | |
| 407 | |
| 408 | 0.052 |
| 409 | 0.046 |
| 410 | 0.064 |
| 411 | 0.08 |
| 412 | 0.089 |
| 413 | 0.072 |
| 414 | 0.062 |
| 415 | 0.084 |
| 416 | 0.059 |
| 417 | 0.074 |
| 418 | 0.063 |
| 419 | 0.47 |
| 420 | 0.52 |
| 421 | 0.19 |
| 422 | 0.1 |
| 423 | 0.24 |
| 424 | 0.05 |
| 425 | 0.086 |
| 426 | 0.21 |
| 427 | 0.0066 |
| 428 | 0.016 |
| 429 | 0.15 |
| 430 | 0.22 |
| 431 | 0.18 |
| 432 | 0.12 |
| 433 | 0.0051 |
| 434 | 0.0067 |
| 435 | 0.12 |
| 436 | 0.26 |
| 437 | 0.015 |
| 438 | 0.22 |
| 439 | 0.1 |
| 440 | 0.0094 |
| 441 | 0.075 |
| 442 | 0.0068 |
| 443 | 0.0044 |
| 444 | 0.0086 |
| 445 | |
| 446 | |
| 447 | 0.023 |
| 448 | 0.048 |
| 449 | 0.012 |
| 450 | 8.02 |
| 451 | 0.011 |
| 452 | 0.0057 |
| 453 | 0.018 |
| 454 | 0.0062 |
| 455 | 0.012 |
| 456 | 0.046 |
| 457 | 0.024 |
| 458 | 0.0061 |
| 459 | 0.016 |
| 460 | 0.021 |
| 461 | 0.014 |
| 462 | 0.011 |
| 463 | |
| 464 | 0.019 |
| 465 | 0.0068 |
| 466 | 0.016 |
| 467 | 0.0055 |
| 468 | 0.016 |
| 469 | 0.0055 |
| 470 | 0.036 |
| 471 | 0.074 |
| 472 | 0.37 |
| 473 | 0.11 |
| 474 | 0.037 |
| 475 | 0.2 |
| 476 | 0.045 |
| 477 | 0.0062 |
| 478 | 0.021 |
| 479 | 0.022 |
| 480 | 0.011 |
| 481 | 0.0066 |
| 482 | 0.009 |
| 483 | 0.021 |
| 484 | 0.0075 |
| 485 | 0.023 |
| 486 | 0.009 |
| 487 | 0.0025 |
| 488 | 0.0022 |
| 489 | 0.0084 |
| 490 | 0.013 |
| 491 | 0.0079 |
| 492 | 0.04 |

DB Cells IL23R pSTAT3 Cell Assay

IL-23 is believed to play a central role in supporting and maintaining Th17 differentiation in vivo. This process is thought to be mediated primarily through the Signal Transducer and Activator of Transcription 3 (STAT3), with phosphorylation of STAT3 (to yield pSTAT3) leading to upregulation of RORC and pro-inflammatory IL-17. This cell assay examines the levels of pSTAT3 in IL-23R-expressing DB cells when stimulated with IL-23 in the presence of test compounds. Serial dilutions of test peptides and IL-23 (Humanzyme #HZ-1261) at a final concentration of 0.5 nM, were added to each well in a 96 well tissue culture plate (Corning #CLS3894). DB cells (ATCC #CRL-2289), cultured in RPMI-1640 medium (Thermo Scientific #11875093) supplemented with 10% FBS, were added at 5 X 10E5 cells/well and incubated for 30 minutes at 37° C. in a 5% $CO_2$ humidified incubator. Changes in phospho-STAT3 levels in the cell lysates were detected using the Cisbio HTRF pSTAT3 (Tyr705) Cellular Assay Kit (Cisbio #62AT3PEH), according to manufacturer's Two Plate Assay protocol. $IC_{50}$ values determined from these data are shown in Table 6. Where not shown or it is marked as "0", data was not yet determined.

TABLE 6

IL-23 Cell Data

| Example | $IC_{50}$ (nM) |
|---|---|
| 201 | |
| 202 | |
| 203 | |
| 204 | |
| 205 | 0.038 |
| 206 | 0.129 |
| 207 | 0.631 |

TABLE 6-continued

IL-23 Cell Data

| Example | $IC_{50}$ (nM) |
|---|---|
| 208 | 0.056 |
| 209 | 0.07 |
| 210 | 0.0798 |
| 211 | 0.062 |
| 212 | |
| 213 | 0.13 |
| 214 | 0.433 |
| 215 | 0.0393 |
| 216 | 0.215 |
| 217 | 1.37 |
| 218 | 1.01 |
| 219 | 2.87 |
| 220 | 2.68 |
| 221 | 5.22 |
| 222 | 2.62 |
| 223 | 0.801 |
| 224 | 0.807 |
| 225 | 0.811 |
| 226 | 0.633 |
| 227 | 0.784 |
| 228 | 5.11 |
| 229 | 3.51 |
| 230 | 5.35 |
| 231 | 2.83 |
| 232 | 0.176 |
| 233 | 0.188 |
| 234 | 0.512 |
| 235 | 0.585 |
| 236 | >10 |
| 237 | 4.74 |
| 238 | 4.24 |
| 239 | 5.16 |
| 240 | 0.424 |
| 241 | 0.35 |
| 242 | 4.15 |
| 243 | 4.3 |
| 244 | 8.98 |
| 245 | >10 |
| 246 | >10 |
| 247 | >10 |
| 248 | 0.257 |
| 249 | |
| 250 | 1.22 |
| 251 | >10 |
| 252 | >10 |
| 253 | 4.58 |
| 254 | 4.38 |
| 255 | 2.01 |
| 256 | 3.37 |
| 257 | 3.37 |
| 258 | 3.97 |
| 259 | 2.07 |
| 260 | 2.62 |
| 261 | >10 |
| 262 | >10 |
| 263 | >10 |
| 264 | >10 |
| 265 | >10 |
| 266 | >10 |
| 267 | >10 |
| 268 | >10 |
| 269 | 2.63 |
| 270 | >10 |
| 271 | >10 |
| 272 | >10 |
| 273 | >10 |
| 274 | >10 |
| 275 | 2.37 |
| 276 | 3.42 |
| 277 | 0.526 |
| 278 | 0.607 |
| 279 | 0.277 |
| 280 | 0.498 |
| 281 | 0.316 |
| 282 | 0.481 |
| 283 | 0.417 |

TABLE 6-continued

IL-23 Cell Data

| Example | $IC_{50}$ (nM) |
|---|---|
| 284 | 0.626 |
| 285 | 0.283 |
| 286 | 0.0719 |
| 287 | 0.0806 |
| 288 | 5.38 |
| 289 | 1.99 |
| 290 | 0.625 |
| 291 | 0.106 |
| 292 | 1.07 |
| 293 | 0.121 |
| 294 | 0.0746 |
| 295 | 0.278 |
| 296 | 0.224 |
| 297 | 0.42 |
| 298 | 0.298 |
| 299 | 0.473 |
| 300 | 0.293 |
| 301 | |
| 302 | 0.692 |
| 303 | 0.12 |
| 304 | 0.879 |
| 305 | 0.126 |
| 306 | 1 |
| 307 | 7.36 |
| 308 | 0.158 |
| 309 | 5.09 |
| 310 | 0.615 |
| 311 | 0.058 |
| 312 | 0.154 |
| 313 | 0.076 |
| 314 | 0.0266 |
| 315 | 0.129 |
| 316 | 0.0567 |
| 317 | 0.165 |
| 318 | 1.34 |
| 319 | 1.03 |
| 320 | 0.634 |
| 321 | |
| 322 | |
| 323 | |
| 324 | |
| 325 | |
| 326 | |
| 327 | |
| 328 | |
| 329 | |
| 330 | |
| 331 | |
| 332 | |
| 333 | |
| 334 | |
| 335 | |
| 336 | |
| 337 | 2.63 |
| 338 | 0.137 |
| 339 | 0.0701 |
| 340 | |
| 341 | |
| 342 | |
| 343 | |
| 344 | |
| 345 | |
| 346 | |
| 347 | |

PBMC pSTAT3 assay

Cryopreserved peripheral blood mononuclear cells (PBMCs) from healthy donors were thawed and washed twice in ImmunoCult-XF T cell expansion medium (XF-TCEM) supplemented with CTL anti-aggregate wash. The cells were counted, resuspended at $2\times10^5$ cells per mL XF-TCEM supplemented with penicillin/streptomycin and 100 ng/mL IL-1β (BioLegend, 579404), and cultured in tissue culture flasks coated with anti-CD3 (eBioscience, 16-0037-85 or BD Pharmingen, 555329) at 37° C. in 5% $CO_2$. On day 4 of culture, PBMCs were collected, washed twice in RPMI-1640 supplemented with 0.1% BSA (RPMI-BSA), and incubated in RPMI-BSA in upright tissue culture flasks for 4 hours at 37° C. in 5% C02. Following this 'starvation,' a total of $6 \times 10^4$ cells in 30 μL RPMI-BSA was transferred into each well of a 384-well plate pre-spotted with peptide in DMSO. The cells were incubated for 30 minutes prior to the addition of IL-23 at a final concentration of 5 ng/mL. The cells were stimulated withcytokine for 30 minutes at 37° C. in 5% $CO_2$, transferred onto ice for 10 minutes, and lysed. Cell lysates were stored at −80° C. until phosphorylated STAT3 was measured using the phospho-STAT panel kit (Meso Scale Discovery, K15202D). The results produced for several compounds with PBMCs are provide in Table 7 below.

TABLE 7

| Example in Discloure/ Compound No. | PBMC pSTAT3 IC50 (nM) | SEQ ID NO: |
|---|---|---|
| 2 | 0.50 | 2 |
| 4 | 1.2 | 4 |
| 3 | 5.7 | 3 |
| 11 | 1.3 | 11 |
| 5 | 0.16 | 5 |
| 6 | 0.7 | 6 |
| 12 | 5.0 | 12 |
| 8 | 0.21 | 8 |
| 14 | 0.78 | 14 |
| 13 | 0.27 | 13 |
| 9 | 0.23 | 9 |
| 10 | 4.8 | 10 |
| 7 | 0.42 | 7 |
| 15 | 0.42 | 15 |
| 16 | 0.18 | 16 |

Although the foregoing invention has been described in some detail by way of illustration and Example for purposes of clarity of understanding, one of skill in the art will appreciate that certain changes and modifications may be practiced within the scope of the appended aspects.

SEQUENCE LISTING (443 sequences)

SEQ ID NO: 1 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,27S)-27-amino-5,21-dioxo-2-palmitamido-9,12,15,18-tetra oxa-6,22-diazaoctacosanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XLTWXXXXXLLXG

SEQ ID NO: 2 - protein, 15 aa, synthetic construct
  REGION 1..15: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note = N6-Acetyl-L-lysine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
RXNTWKCXXXENXGX

SEQ ID NO: 3 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = (3-carbamoylbenzyl)glycine
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXX

SEQ ID NO: 4 - protein, 14 aa, synthetic construct
  REGION 1..14: note = Modified peptide
  SITE 1: note = C-terminal is: Acetyl
  SITE 1: note = D-Arginine
  MOD_RES 2: note = Abu
  MOD_RES 6: note = N6-Acetyl-L-lysine
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-dodecanamido-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: Abu to C
  DISULFID 2..7: note = Disulfid bond
RXNTWKCXXXXNXG

SEQ ID NO: 5 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 6 - protein, 14 aa, synthetic construct
  REGION 1..14: note = Modified peptide
  MOD_RES 1: note (S)-22-carboxy-1,10,19,24-tetraoxo-3,6,12,15-tetraoxa-9,18, 23-triazahentetracontan-41-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXXNXG

SEQ ID NO: 7 - protein, 14 aa, synthetic construct
  REGION 1..14: note = Modified peptide
  SITE 1: note = C-terminal is: Acetyl
  MOD_RES 1: note = (R)-6-amino-6-carboxy-N,N,N-trimethylhexan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid  bond
KXNTWKXXXXXNXG

SEQ ID NO: 8 - protein, 13 aa, synthetic construct
  REGION 1..13: note = Modified peptide
  SITE 1: note = C-terminal is: ac
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note (1R,50S)-1-amino-7,47,52-trioxo-10,13,16,19,22,25,28,31,34, 37,40,43-dodecaoxa-6,46,51-triazaoctahexacontane-1,50,68-tr icarboxylic acid
  SITE 13: note = C-terminal is: amido
  REGION 1..6: note = Cyclic bond: L-penicillamine to L-penicillamine
  DISULFID 1..6: note = Disulfid bond
XLTWKXXXXKLXX

SEQ ID NO: 9 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine(G)
  MOD_RES 8: note = 2-naphthylalanine
  MOD_RES 9: note = 4-amino-4-carboxy-tetrahydropyran
  MOD_RES 10: note (2S,29S)-29-amino-5,14,23-trioxo-2-tetradecanamido-9,12,18, 21-tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 10 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XNTWKXXXXXNXG

SEQ ID NO: 11 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXNTWKXXXXXNXG

SEQ ID NO: 12 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-5,14,23-trioxo-2-tetradecanamido-9,12,18, 21-tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-5,14,23-trioxo-2-tetradecanamido-9,12,18, 21-tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXXNXG

SEQ ID NO: 13 - protein, 13 aa, synthetic construct
  REGION 1..13: note = Modified peptide
  SITE 1: note = C-terminal is: Decyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XNTWKXXXXLNXG

SEQ ID NO: 14 - protein, 13 aa, synthetic construct
  REGION 1..13: note = Modified peptide
  SITE 1: note = C-terminal is: Oct
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XNTWKXXXXLNXG

SEQ ID NO: 15 - protein, 14 aa, synthetic construct
  REGION 1..14: note = Modified peptide
  SITE 1: note = C-terminal is: Acetyl
  MOD_RES 1: note (2S,29R)-29-amino-2-(10-(3-carboxyphenoxy)decanamido)-5,14, 23-trioxo-9,12,18,21-tetraoxa-6,15,24-triazatriacontanedioi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-(10-(3-carboxyphenoxy)decanamido)-5,14, 23-trioxo-9,12,18,21-tetraoxa-6,15,24-triazatriacontanedioi c acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXXNXG

SEQ ID NO: 16 - protein, 14 aa, synthetic construct
  REGION 1..14: note = Modified peptide
  SITE 1: note = C-terminal is: Acetyl
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 17 - protein, 15 aa, synthetic construct
  REGION 1..15: note = Modified peptide
  SITE 1: note = C-terminal is: Acetyl
  MOD_RES 1: note (R)-2-((5-amino-5-carboxypentyl)amino)-N-(2-aminoethyl)-N,N -dimethyl-2-oxoethan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
XXNTWKXXXXENXGX

SEQ ID NO: 18 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is: amido
  REGION 2..7: note = Cyclic bond: L-penicillamine to L-penicillamine
  DISULFID 2..7: note = Disulfid bond
XXNTWKXXXXXNXG

SEQ ID NO: 19 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-((1r,4S)-4-((19-carboxynonadecanamido)m ethyl)cyclohexane-1-carboxamido)-5,14,23-trioxo-9,12,18,21- tetraoxa-6,15,24-triazatriacontanedioic acid
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XXTWKXXXXXNXG

SEQ ID NO: 20 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is: amido
  REGION 2..7: note = Cyclic bond: L-penicillamine to L-penicillamine
  DISULFID 2..7: note = Disulfid bond
XXNTWKXXXXXNXG

SEQ ID NO: 21 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is: amido
  REGION 2..7: note = Cyclic bond: L-penicillamine to L-penicillamine
  DISULFID 2..7: note = Disulfid bond
XXNTWKXXXXXNXG

SEQ ID NO: 22 - protein, 13 aa, synthetic construct
  REGION 1..13: note = Modified peptide
  SITE 1: note = C-terminal is: Acetyl
  MOD_RES 6: note = L-penicillamine
  MOD_RES 4: note = 7-methyl-L-tryptophan
  MOD_RES 5: note = N6-Acetyl-L-lysine
  MOD_RES 1: note = L-penicillamine
  MOD_RES 7: note = 4-(2-aminoethoxy)-L-phenylalanine
  MOD_RES 8: note = (S)-2-amino-3-(quinolin-3-yl)propanoic Acetylid
  MOD_RES 9: note = 4-amino-4-carboxy-tetrahydropyran
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid  bond
XNTWKXXXXENHG

SEQ ID NO: 23 - protein, 14 aa, synthetic construct
  REGION 1..14: note = Modified peptide
  SITE 1: note = C-terminal is: Acetyl
  MOD_RES 1: note (2S,29R)-29-amino-2-(10-(3-carboxyphenoxy)decanamido)-5,14, 23-trioxo-9,12,18,21-tetraoxa-6,15,24-triazatriacontanedioi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXXNXG

SEQ ID NO: 24 - protein, 14 aa, synthetic construct
  REGION 1..14: note = Modified peptide
  SITE 1: note = C-terminal is: Acetyl
  MOD_RES 1: note (1R,41S)-1-amino-7,16,38,43-tetraoxo-9,12,19,22,25,28,31,34 -octaoxa-6,15,37,42-tetraazanonapentacontane-1,41,59-tricar boxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 25 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 26 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,32S)-1-amino-7,29,34-trioxo-10,13,16,19,22,25-hexaoxa-6 ,28,33-triazapentacontane-1,32,50-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 27 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((S)-1-((S)-4-carboxy-4-(17-carboxyheptadeca namido)butanoyl)pyrrolidin-2-yl)-1,10,19-trioxo-5,8,14,17-t etraoxa-2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 28 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (S)-25-amino-1-((S)-1-(17-carboxyheptadecanoyl)pyrrolidin-2 -yl)-1,10,19-trioxo-5,8,14,17-tetraoxa-2,11,20-triazahexaco san-26-oic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 29 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,86S)-1-amino-7,83,88-trioxo-10,13,16,19,22,25,28,31,34, 37,40,43,46,49,52,55,58,61,64,67,70,73,76,79-tetracosaoxa-6 ,82,87-triazadohectane-1,86,102-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 30 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28R)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 31 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,86S)-1-amino-7,83,88-trioxo-10,13,16,19,22,25,28,31,34, 37,40,43,46,49,52,55,58,61,64,67,70,73,76,79-tetracosaoxa-6 ,82,87-triazadohectane-1,86,102-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 32 - protein, 14 aa, synthetic construct
  REGION 1..14: note = Modified peptide
  SITE 1: note = C-terminal is: Acetyl
  MOD_RES 1: note (1S,19S)-1-amino-7,16,21-trioxo-9,12-dioxa-6,15,20-triazahe ptatriacontane-1,19,37-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 33 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 34 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 35 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-(10-(3-carboxyphenoxy)decanamido)-5,14, 23-trioxo-9,12,18,21-tetraoxa-6,15,24-triazatriacontanedioi c acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 36 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((S)-1-((S)-4-carboxy-4-(17-carboxyheptadeca namido)butanoyl)pyrrolidin-2-yl)-1,10,19-trioxo-5,8,14,17-t etraoxa-2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 37 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (S)-25-amino-1-((R)-1-(17-carboxyheptadecanoyl)pyrrolidin-2 -yl)-1,10,19-trioxo-5,8,14,17-tetraoxa-2,11,20-triazahexaco san-26-oic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 38 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 39 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note (S)-1-(4-((S)-2-amino-2-carboxyethyl)phenoxy)-25-carboxy-4, 13,22,27-tetraoxo-6,9,15,18-tetraoxa-3,12,21,26-tetraazadot etracontan-42-oic acid
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXKNXG

SEQ ID NO: 40 - protein, 14 aa, synthetic construct
  REGION 1..14: note = Modified peptide
  SITE 1: note = C-terminal is: Acetyl
  MOD_RES 1: note (2S,29R)-29-amino-2-(10-(4-carboxyphenoxy)decanamido)-5,14, 23-trioxo-9,12,18,21-tetraoxa-6,15,24-triazatriacontanedioi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-(10-(4-carboxyphenoxy)decanamido)-5,14, 23-trioxo-9,12,18,21-tetraoxa-6,15,24-triazatriacontanedioi c acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXXNXG

SEQ ID NO: 41 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-((1r,4S)-4-((17-carboxyheptadecanamido) methyl)cyclohexane-1-carboxamido)-5,14,23-trioxo-9,12,18,21 -tetraoxa-6,15,24-triazatriacontanedioic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 42 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 43 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,19S)-1-amino-7,16,21-trioxo-9,12-dioxa-6,15,20-triazahe ptatriacontane-1,19,37-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 44 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazanonatriacontan-39-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = K(PEG2PEG2-gEC16OH)
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 45 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 46 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note (2S,51R)-51-amino-5,45-dioxo-2-palmitamido-9,12,15,18,21,24 ,27,30,33,36,39,42-dodecaoxa-6,46-diazadopentacontanedioic acid
  SITE 13: note = C-terminal is:amido
  REGION 1..6: note = Cyclic bond: L-penicillamine to L-penicillamine
  DISULFID 1..6: note = Disulfid bond
XLTWKXXXXKLXX

SEQ ID NO: 47 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = K(PEG2PEG2-gEC16OH)
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 48 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,41S)-1-amino-7,16,38,43-tetraoxo-9,12,19,22,25,28,31,34 -octaoxa-6,15,37,42-tetraazanonapentacontane-1,41,59-tricar boxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 49 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 50 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 51 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 52 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 53 - protein, 14 aa, synthetic construct
  REGION 1..14: note = Modified peptide
  SITE 1: note = C-terminal is: Acetyl
  MOD_RES 1: note (2S,29R)-29-amino-2-((1r,4S)-4-((17-carboxyheptadecanamido) methyl)cyclohexane-1-carboxamido)-5,14,23-trioxo-9,12,18,21 -tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 54 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (3S,30S)-9,18,27,32-tetraoxo-11,14,20,23-tetraoxa-2,8,17,26 ,31-pentaazaoctatetracontane-3,30,48-tricarboxylic acid
  REGION 2..7: note = Cyclic bond: L-penicillamine to L-penicillamine
  DISULFID 2..7: note = Disulfid bond
XXNTWKXXXXENXX

SEQ ID NO: 55 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-((1r,4S)-4-((19-carboxynonadecanamido)m ethyl)cyclohexane-1-carboxamido)-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 56 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((1S,4r)-4-(((S)-4-carboxy-4-(19-carboxynona decanamido)butanamido)methyl)cyclohexyl)-1,10,19-trioxo-5,8 ,14,17-tetraoxa-2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 57 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((1S,4r)-4-(((S)-4-carboxy-4-((1r,4S)-4-((19 -carboxynonadecanamido)methyl)cyclohexane-1-carboxamido)but anamido)methyl)cyclohexyl)-1,10,19-trioxo-5,8,14,17-tetraox a-2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 58 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((R)-1-((17-carboxyheptadecanoyl)-D-prolyl-D -prolyl)pyrrolidin-2-yl)-1,10,19-trioxo-5,8,14,17-tetraoxa- 2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 59 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-26-amino-26-carboxy-N-(2-((S)-4-carboxy-4-(17-carboxyhe ptadecanamido)butanamido)ethyl)-N,N-dimethyl-2,11,20-trioxo -6,9,15,18-tetraoxa-3,12,21-triazahexacosan-1-aminium
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 60 - protein, 14 aa, synthetic construct
  REGION 1..14: note = Modified peptide
  SITE 1: note = C-terminal is: Acetyl
  MOD_RES 1: note (2S,29R)-29-amino-2-((1r,4S)-4-((19-carboxynonadecanamido)m ethyl)cyclohexane-1-carboxamido)-5,14,23-trioxo-9,12,18,21- tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 61 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-2-((1r,4S)-4-((17-carboxyheptadecanamido) methyl)cyclohexane-1-carboxamido)-5,14,23-trioxo-9,12,18,21 -tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKNXG

SEQ ID NO: 62 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-2-((1r,4S)-4-((19-carboxynonadecanamido)m ethyl)cyclohexane-1-carboxamido)-5,14,23-trioxo-9,12,18,21- tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKNXG

SEQ ID NO: 63 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 3: note = K(PEG2PEG2gEC16OH)
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 64 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 65 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-N-((S)-17-amino-17-carboxy-2,11-dioxo-6,9-dioxa-3,12-di azaheptadecyl)-16,34-dicarboxy-N,N-dimethyl-4,13,18-trioxo- 6,9-dioxa-3,12,17-triazatetratriacontan-1-aminium
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 66 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,32S)-1-amino-7,29,34-trioxo-10,13,16,19,22,25-hexaoxa-6 ,28,33-triazaoctatetracontane-1,32,48-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 67 - protein, 14 aa, synthetic construct
  REGION 1..14: note = Modified peptide
  SITE 1: note = C-terminal is: ac
  MOD_RES 1: note (1R,28S)-1-amino-7,16,25,30-tetraoxo-9,12,18,21-tetraoxa-6, 15,24,29-tetraazaoctatetracontane-1,28,48-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 68 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 69 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 70 - protein, 14 aa, synthetic construct
  REGION 1..14: note = Modified peptide
  SITE 1: note = C-terminal is: Acetyl
  MOD_RES 1: note (2S,29R)-29-amino-5,14,23-trioxo-2-palmitamido-9,12,18,21-t etraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 71 - protein, 14 aa, synthetic construct
  REGION 1..14: note = Modified peptide
  SITE 1: note = C-terminal is: Acetyl
  MOD_RES 1: note (2S,29R)-29-amino-5,14,23-trioxo-2-stearamido-9,12,18,21-te traoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 72 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-5,14,23-trioxo-2-palmitamido-9,12,18,21-t etraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKNXG

SEQ ID NO: 73 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-5,14,23-trioxo-2-stearamido-9,12,18,21-te traoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKNXG

SEQ ID NO: 74 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 2..7: note = Cyclic bond: L-penicillamine to L-penicillamine
  DISULFID 2..7: note = Disulfid bond
XXTWKXXXXKNXG

SEQ ID NO: 75 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazaoctatriacontane-1,28,38-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXXNXG

SEQ ID NO: 76 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWXXXXXKNXG

SEQ ID NO: 77 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXXTWKXXXXKNXG

SEQ ID NO: 78 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (S)-25-amino-1-((S)-1-((S)-4-carboxy-4-(17-carboxyheptadeca namido)butanoyl)pyrrolidin-2-yl)-1,10,19-trioxo-5,8,14,17-t etraoxa-2,11,20-triazahexacosan-26-oic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 79 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (S)-25-amino-1-((S)-1-((S)-4-carboxy-4-(17-carboxyheptadeca namido)butanoyl)pyrrolidin-2-yl)-1,10,19-trioxo-5,8,14,17-t etraoxa-2,11,20-triazahexacosan-26-oic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 80 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (S)-25-amino-1-((S)-1-(((S)-4-carboxy-4-(17-carboxyheptadec anamido)butanoyl)-L-prolyl-L-prolyl)pyrrolidin-2-yl)-1,10,1 9-trioxo-5,8,14,17-tetraoxa-2,11,20-triazahexacosan-26-oic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 81 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (S)-25-amino-1-((S)-1-(((S)-4-carboxy-4-(17-carboxyheptadec anamido)butanoyl)-L-prolyl-L-prolyl)pyrrolidin-2-yl)-1,10,1 9-trioxo-5,8,14,17-tetraoxa-2,11,20-triazahexacosan-26-oic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 82 - protein, 14 aa, synthetic construct
  REGION 1..14: note = Modified peptide
  SITE 1: note = C-terminal is: Acetyl
  MOD_RES 1: note (R)-25-amino-1-((S)-1-((S)-4-carboxy-4-(17-carboxyheptadeca namido)butanoyl)pyrrolidin-2-yl)-1,10,19-trioxo-5,8,14,17-t etraoxa-2,11,20-triazahexacosan-26-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 83 - protein, 14 aa, synthetic construct
  REGION 1..14: note = Modified peptide
  SITE 1: note = C-terminal is: Acetyl
  MOD_RES 1: note (1S,28S)-1-amino-7,16,25,30-tetraoxo-9,12,18,21-tetraoxa-6, 15,24,29-tetraazatetracontane-1,28,40-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 84 - protein, 14 aa, synthetic construct
  REGION 1..14: note = Modified peptide
  SITE 1: note = C-terminal is: Acetyl
  MOD_RES 1: note (R)-25-amino-1-((S)-1-(((S)-4-carboxy-4-(17-carboxyheptadec anamido)butanoyl)-L-prolyl-L-prolyl)pyrrolidin-2-yl)-1,10,1 9-trioxo-5,8,14,17-tetraoxa-2,11,20-triazahexacosan-26-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 85 - protein, 14 aa, synthetic construct
  REGION 1..14: note = Modified peptide
  SITE 1: note = C-terminal is: Acetyl
  MOD_RES 1: note (R)-25-amino-1-((S)-1-(((S)-4-carboxy-4-(17-carboxyheptadec anamido)butanoyl)-L-prolyl-L-prolyl)pyrrolidin-2-yl)-1,10,1 9-trioxo-5,8,14,17-tetraoxa-2,11,20-triazahexacosan-26-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 86 - protein, 13 aa, synthetic construct
  REGION 1..13: note = Modified peptide
  SITE 1: note = C-terminal is: N-(2-(2-(3-oxopropoxy)ethoxy)ethyl)decanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 87 - protein, 13 aa, synthetic construct
  REGION 1..13: note = Modified peptide
  SITE 1: note = C-terminal is: N-(2-(2-(3-oxopropoxy)ethoxy)ethyl)octanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 88 - protein, 14 aa, synthetic construct
  REGION 1..14: note = Modified peptide
  SITE 1: note = C-terminal is: Acetyl
  MOD_RES 1: note (R)-25-amino-1-((1S,4r)-4-(((S)-4-carboxy-4-(17-carboxyhept adecanamido)butanamido)methyl)cyclohexyl)-1,10,19-trioxo-5, 8,14,17-tetraoxa-2,11,20-triazahexacosan-26-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 89 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = K(PEG2PEG2-gEC16OH)
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 90 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-N-(2-(((S)-5-amino-5-carboxypentyl)amino)-2-oxoethyl)-2 5,43-dicarboxy-N,N-dimethyl-4,13,22,27-tetraoxo-6,9,15,18-t etraoxa-3,12,21,26-tetraazatritetracontan-1-aminium
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXXNXG

SEQ ID NO: 91 - protein, 14 aa, synthetic construct
  REGION 1..14: note = Modified peptide
  SITE 1: note = C-terminal is: PEG2PEG2-gEC16OH
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXKNXG

SEQ ID NO: 92 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,27S)-27-amino-2-((S)-2,3-bis(10-(3-carboxyphenoxy)decan amido)propanamido)-5,21-dioxo-9,12,15,18-tetraoxa-6,22-diaz aoctacosanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 93 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 94 - protein, 14 aa, synthetic construct
  REGION 1..14: note = Modified peptide
  SITE 1: note = C-terminal is: Acetyl
  MOD_RES 1: note (2S,29R)-29-amino-2-(10-(3-carboxyphenoxy)decanamido)-5,14, 23-trioxo-9,12,18,21-tetraoxa-6,15,24-triazatriacontanedioi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 95 - protein, 14 aa, synthetic construct
  REGION 1..14: note = Modified peptide
  SITE 1: note = C-terminal is: Acetyl
  MOD_RES 1: note 16-(((S)-3-(((R)-5-amino-5-carboxypentyl)amino)-2-((15-carb oxypentadecyl)amino)-3-oxopropyl)amino)-16-oxohexadecanoic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 96 - protein, 14 aa, synthetic construct
  REGION 1..14: note = Modified peptide
  SITE 1: note = C-terminal is: Acetyl
  MOD_RES 1: note (1R,28S,31S)-1-amino-31-((15-carboxypentadecyl)amino)-7,16, 25,30,34-pentaoxo-9,12,18,21-tetraoxa-6,15,24,29,33-pentaaz aoctatetracontane-1,28,48-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 97 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (S)-25-amino-1-((S)-1-((17-carboxyheptadecanoyl)-L-prolyl-L -prolyl)pyrrolidin-2-yl)-1,10,19-trioxo-5,8,14,17-tetraoxa- 2,11,20-triazahexacosan-26-oic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 98 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 99 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKNXG

SEQ ID NO: 100 - protein, 14 aa, synthetic construct
  REGION 1..14: note = Modified peptide
  SITE 1: note = C-terminal is: Acetyl
  MOD_RES 1: note (4S,31R)-31-amino-4,31-dicarboxy-N-(2-(17-carboxyheptadecan amido)ethyl)-N,N-dimethyl-2,7,16,25-tetraoxo-11,14,20,23-te traoxa-3,8,17,26-tetraazahentriacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 101 - protein, 14 aa, synthetic construct
  REGION 1..14: note = Modified peptide
  SITE 1: note = C-terminal is: Acetyl
  MOD_RES 1: note (S)-N-((R)-17-amino-17-carboxy-2,11-dioxo-6,9-dioxa-3,12-di azaheptadecyl)-16,34-dicarboxy-N,N-dimethyl-4,13,18-trioxo- 6,9-dioxa-3,12,17-triazatetratriacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 102 - protein, 14 aa, synthetic construct
  REGION 1..14: note = Modified peptide
  SITE 1: note = C-terminal is: Acetyl
  MOD_RES 1: note (S)-N-(2-(((R)-5-amino-5-carboxypentyl)amino)-2-oxoethyl)-2 5,43-dicarboxy-N,N-dimethyl-4,13,22,27-tetraoxo-6,9,15,18-t etraoxa-3,12,21,26-tetraazatritetracontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid  bond
XXNTWKXXXXKNXG

SEQ ID NO: 103 - protein, 14 aa, synthetic construct
  REGION 1..14: note = Modified peptide
  SITE 1: note = C-terminal is: Acetyl
  MOD_RES 1: note (2S,27S)-27-amino-2-((S)-2,3-bis(10-(4-carboxyphenoxy)decan amido)propanamido)-5,21-dioxo-9,12,15,18-tetraoxa-6,22-diaz aoctacosanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 104 - protein, 14 aa, synthetic construct
  REGION 1..14: note = Modified peptide
  SITE 1: note = C-terminal is: Acetyl
  MOD_RES 1: note (R)-16-((1-((5-amino-5-carboxypentyl)amino)-3-hydroxy-2-(hy droxymethyl)-1-oxopropan-2-yl)amino)-16-oxohexadecanoic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 105 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,41S)-1-amino-7,16,38,43-tetraoxo-9,12,19,22,25,28,31,34 -octaoxa-6,15,37,42-tetraazaheptapentacontane-1,41,57-trica rboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 106 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,41S)-1-amino-7,16,38,43-tetraoxo-9,12,19,22,25,28,31,34 -octaoxa-6,15,37,42-tetraazanonapentacontane-1,41,59-tricar boxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 107 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,32S)-1-amino-7,29,34-trioxo-10,13,16,19,22,25-hexaoxa-6 ,28,33-triazapentacontane-1,32,50-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 108 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,54S)-1-amino-7,29,51,56-tetraoxo-10,13,16,19,22,25,32,3 5,38,41,44,47-dodecaoxa-6,28,50,55-tetraazaheptacontane-1,5 4,70-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 109 - protein, 14 aa, synthetic construct
  REGION 1..14: note = Modified peptide
  SITE 1: note = C-terminal is: Acetyl
  MOD_RES 1: note (R)-16-((1-((5-amino-5-carboxypentyl)amino)-3-hydroxy-2-(hy droxymethyl)-1-oxopropan-2-yl)amino)-16-oxohexadecanoic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 110 - protein, 14 aa, synthetic construct
  REGION 1..14: note = Modified peptide
  SITE 1: note = C-terminal is: Acetyl
  MOD_RES 1: note (R)-18-((1-((5-amino-5-carboxypentyl)amino)-3-hydroxy-2-(hy droxymethyl)-1-oxopropan-2-yl)amino)-18-oxooctadecanoic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 111 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (S)-25-amino-1-((S)-1-((17-carboxyheptadecanoyl)-L-prolyl-L -prolyl)pyrrolidin-2-yl)-1,10,19-trioxo-5,8,14,17-tetraoxa- 2,11,20-triazahexacosan-26-oic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXXNXG

SEQ ID NO: 112 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((R)-1-((17-carboxyheptadecanoyl)-D-prolyl-D -prolyl)pyrrolidin-2-yl)-1,10,19-trioxo-5,8,14,17-tetraoxa- 2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 113 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-2-amino-8,84-dioxo-11,14,17,20,23,26,29,32,35,38,41,44, 47,50,53,56,59,62,65,68,71,74,77,80-tetracosaoxa-7,83-diaza henhectanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 114 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXXNXG

SEQ ID NO: 115 - protein, 14 aa, synthetic construct
  REGION 1..14: note = Modified peptide
  SITE 1: note = C-terminal is: Acetyl
  MOD_RES 1: note (R)-2-amino-27,27-bis(hydroxymethyl)-8,17,26,29-tetraoxo-10 ,13,19,22-tetraoxa-7,16,25,28-tetraazahexatetracontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 116 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (R)-2-amino-8,24-dioxo-11,14,17,20-tetraoxa-7,23-diazahente tracontanedioic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 117 - protein, 14 aa, synthetic construct
  REGION 1..14: note = Modified peptide
  SITE 1: note = C-terminal is: Acetyl
  MOD_RES 1: note (2R,23S,50R)-50-amino-23,50-dicarboxy-2-(carboxymethyl)-N,N ,N-trimethyl-4,21,26,35,44-pentaoxo-30,33,39,42-tetraoxa-3, 22,27,36,45-pentaazapentacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 118 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,54S)-1-amino-7,29,51,56-tetraoxo-10,13,16,19,22,25,32,3 5,38,41,44,47-dodecaoxa-6,28,50,55-tetraazadoheptacontane-1 ,54,72-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 119 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 120 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,19S)-1-amino-7,16,21-trioxo-9,12-dioxa-6,15,20-triazape ntatriacontane-1,19,35-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 121 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,19S)-1-amino-7,16,21-trioxo-9,12-dioxa-6,15,20-triazahe ptatriacontane-1,19,37-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 122 - protein, 14 aa, synthetic construct
  REGION 1..14: note = Modified peptide
  SITE 1: note = C-terminal is: Acetyl
  MOD_RES 1: note (R)-45-amino-1-hydroxy-2-(hydroxymethyl)-4,21,30,39-tetraox o-25,28,34,37-tetraoxa-3,22,31,40-tetraazahexatetracontan-4 6-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 123 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-(10-(4-carboxyphenoxy)decanamido)-5,14, 23-trioxo-9,12,18,21-tetraoxa-6,15,24-triazatriacontanedioi c acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 124 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (S)-2-amino-8,17,26-trioxo-10,13,19,22-tetraoxa-7,16,25-tri azatritetracontanedioic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXKNXG

SEQ ID NO: 125 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (4S,31S)-31-amino-4,31-dicarboxy-N-(2-(17-carboxyheptadecan amido)ethyl)-N,N-dimethyl-2,7,16,25-tetraoxo-11,14,20,23-te traoxa-3,8,17,26-tetraazahentriacontan-1-aminium
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXXNXG

SEQ ID NO: 126 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-2-amino-8,17,26-trioxo-10,13,19,22-tetraoxa-7,16,25-tri azahentetracontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 127 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-2-amino-8,17,26-trioxo-10,13,19,22-tetraoxa-7,16,25-tri azatritetracontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 128 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (S)-25-amino-1-((1S,4r)-4-(((S)-4-carboxy-4-(17-carboxyhept adecanamido)butanamido)methyl)cyclohexyl)-1,10,19-trioxo-5, 8,14,17-tetraoxa-2,11,20-triazahexacosan-26-oic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 129 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXXTWKXXXXENXG

SEQ ID NO: 130 - protein, 14 aa, synthetic construct
  REGION 1..14: note = Modified peptide
  SITE 1: note = C-terminal is: Acetyl
  MOD_RES 1: note (2S,5S,32R)-32-amino-32-carboxy-5-(17-carboxyheptadecanamid o)-2-(carboxymethyl)-N,N,N-trimethyl-4,8,17,26-tetraoxo-12, 15,21,24-tetraoxa-3,9,18,27-tetraazadotriacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 131 - protein, 14 aa, synthetic construct
  REGION 1..14: note = Modified peptide
  SITE 1: note = C-terminal is: Acetyl
  MOD_RES 1: note = dK(PEG2PEG2 gE C18OH (C)
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 132 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S,31S)-1-amino-31-((15-carboxypentadecyl)amino)-7,16, 25,30,34-pentaoxo-9,12,18,21-tetraoxa-6,15,24,29,33-pentaaz aoctatetracontane-1,28,48-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 133 - protein, 14 aa, synthetic construct
  REGION 1..14: note = Modified peptide
  SITE 1: note = C-terminal is: Acetyl
  MOD_RES 1: note (1S,19S)-1-amino-7,16,21-trioxo-9,12-dioxa-6,15,20-triazahe ptatriacontane-1,19,37-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = N(4Am-Benzyl)-Gly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXX

SEQ ID NO: 134 - protein, 14 aa, synthetic construct
  REGION 1..14: note = Modified peptide
  SITE 1: note = C-terminal is: Acetyl
  MOD_RES 1: note (1R,32S)-1-amino-7,29,34-trioxo-10,13,16,19,22,25-hexaoxa-6 ,28,33-triazapentacontane-1,32,50-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXG

SEQ ID NO: 135 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = N(4Am-Benzyl)-Gly
  SITE 14: note = C-terminal is:amido
  REGION 2..7: note = Cyclic bond: L-penicillamine to L-penicillamine
  DISULFID 2..7: note = Disulfid bond
XXNTWKXXXXKNXX

SEQ ID NO: 136 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (2S,29S)-29-(methylamino)-5,14,23-trioxo-2-palmitamido-9,12 ,18,21-tetraoxa-6,15,24-triazatriacontanedioic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 137 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note (3S,30S)-9,18,27,32-tetraoxo-11,14,20,23-tetraoxa-2,8,17,26 ,31-pentaazaoctatetracontane-3,30,48-tricarboxylic acid
  SITE 14: note = C-terminal is:amido
  REGION 2..7: note = Cyclic bond: L-penicillamine to L-penicillamine
  DISULFID 2..7: note = Disulfid bond
RXNTWKXXXXKNXX

SEQ ID NO: 138 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1R,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 139 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29R)-29-amino-5,14,23-trioxo-2-palmitamido-9,12,18,21-t etraoxa-6,15,24-triazatriacontanedioic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 140 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (R)-2-amino-8,48-dioxo-11,14,17,20,23,26,29,32,35,38,41,44- dodecaoxa-7,47-diazapentahexacontanedioic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 141 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1R,50S)-1-amino-7,47,52-trioxo-10,13,16,19,22,25,28,31,34, 37,40,43-dodecaoxa-6,46,51-triazaoctahexacontane-1,50,68-tr icarboxylic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 142 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,51R)-51-amino-5,45-dioxo-2-palmitamido-9,12,15,18,21,24 ,27,30,33,36,39,42-dodecaoxa-6,46-diazadopentacontanedioic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 143 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-5,14,23-trioxo-2-tetradecanamido-9,12,18, 21-tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXKNXG

SEQ ID NO: 144 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 145 - protein, 13 aa, synthetic construct
  REGION 1..13: note = Modified peptide:
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 146 - protein, 14 aa, synthetic construct
  REGION 1..14: note = Modified peptide
  SITE 1: note = C-terminal is: Acetyl
  MOD_RES 1: note d(2S,29S)-29-amino-2-dodecanamido-5,14,23-trioxo-9,12,18,21 -tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: carboxamide
  REGION 2..7: note = Cyclic bond: L-penicillamine to L-penicillamine
  DISULFID 2..7: note = Disulfid bond
XXNTWKXXXXKNXG

SEQ ID NO: 147 - protein, 14 aa, synthetic construct
  REGION 1..14: note = Modified peptide:
  SITE 1: note = C-terminal is: Acetyl
  MOD_RES 1: note (2S,29R)-29-amino-5,14,23-trioxo-2-tetradecanamido-9,12,18, 21-tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 148 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXLLNXG

SEQ ID NO: 149 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWXXXXLLNXG

SEQ ID NO: 150 - protein, 14 aa, synthetic construct
  REGION 1..14: note = Modified peptide:
  SITE 1: note = C-terminal is: Acetyl
  MOD_RES 1: note (R)-44-amino-38-oxo-2,5,8,11,14,17,20,23,26,29,32,35-dodeca oxa-39-azapentatetracontan-45-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXLLNXG

SEQ ID NO: 151 - protein, 14 aa, synthetic construct
  REGION 1..14: note = Modified peptide:
  SITE 1: note = C-terminal is: Acetyl
  MOD_RES 1: note (R)-44-amino-38-oxo-2,5,8,11,14,17,20,23,26,29,32,35-dodeca oxa-39-azapentatetracontan-45-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXLLNXG

SEQ ID NO: 152 - protein, 14 aa, synthetic construct
  REGION 1..14: note = Modified peptide:
  SITE 1: note = C-terminal is: Acetyl
  MOD_RES 1: note (R)-44-amino-38-oxo-2,5,8,11,14,17,20,23,26,29,32,35-dodeca oxa-39-azapentatetracontan-45-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXFXLLNXG

SEQ ID NO: 153 - protein, 14 aa, synthetic construct
  REGION 1..14: note = Modified peptide:
  SITE 1: note = C-terminal is: Acetyl
  MOD_RES 1: note (R)-44-amino-38-oxo-2,5,8,11,14,17,20,23,26,29,32,35-dodeca oxa-39-azapentatetracontan-45-oic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXFXLLNXG

SEQ ID NO: 154 - protein, 13 aa, synthetic construct
  REGION 1..13: note = Modified peptide:
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXLLNXG

SEQ ID NO: 155 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWXXFXLLNXG

SEQ ID NO: 156 - protein, 13 aa, synthetic construct
  REGION 1..13: note = Modified peptide
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXFXLLNXG

SEQ ID NO: 157 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXFXLLNXG

SEQ ID NO: 158 - protein, 13 aa, synthetic construct
  REGION 1..13: note = Modified peptide:
  SITE 1: note = C-terminal is: 2,5,8,11-tetraoxatetradecan-14-al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXLLNXG

SEQ ID NO: 159 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKAXG

SEQ ID NO: 160 - protein, 13 aa, synthetic construct
  REGION 1..13: note = Modified peptide:
  SITE 1: note = C-terminal is: Acetyl
  MOD_RES 1: note (R)-2-(2-mercaptopropan-2-yl)-4,20,27-trioxo-7,10,13,16-tet raoxa-3,19,26-triazatetratetracontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: (R)-2-(2-mercaptopropan-2-yl)-4,20,27-trioxo-7,10,13,16-tet raoxa-3,19,26-triazatetratetracontanedioic acid to L-penicillamine
  DISULFID 1..6: note = Disulfid bond
XNTWKXXXXELXG

SEQ ID NO: 161 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKAXG

SEQ ID NO: 162 - protein, 13 aa, synthetic construct
  REGION 1..13: note = Modified peptide:
  SITE 1: note = C-terminal is:
  MOD_RES 1: note (3R,24S)-2-mercapto-2-methyl-5,21,26-trioxo-8,11,14,17-tetr aoxa-4,20,25-triazadotetracontane-3,24,42-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: (3R,24S)-2-mercapto-2-methyl-5,21,26-trioxo-8,11,14,17-tetr aoxa-4,20,25-triazadotetracontane-3,24,42-tricarboxylic acid to L-penicillamine
  DISULFID 1..6: note = Disulfid bond
XNTWKXXXXELXG

SEQ ID NO: 163 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 164 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 11: note (S)-2-amino-8,48-dioxo-11,14,17,20,23,26,29,32,35,38,41,44- dodecaoxa-7,47-diazapentahexacontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXKXXG

SEQ ID NO: 165 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  MOD_RES 14: note (2S,29S)-29-amino-5,14,23-trioxo-2-stearamido-9,12,18,21-te traoxa-6,15,24-triazatriacontanedioic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 166 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 167 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  MOD_RES 14: note (2S,29S)-29-amino-5,14,23-trioxo-2-stearamido-9,12,18,21-te traoxa-6,15,24-triazatriacontanedioic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 168 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note (S)-1-(4-((S)-2-amino-2-carboxyethyl)phenoxy)-25-carboxy-4, 13,22,27-tetraoxo-6,9,15,18-tetraoxa-3,12,21,26-tetraazatet ratetracontan-44-oic acid
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXKNXG

SEQ ID NO: 169 - protein, 14 aa, synthetic construct
  REGION 1..14: note = Modified peptide:
  SITE 1: note = C-terminal is: Acetyl
  MOD_RES 1: note (R)-26-amino-26-carboxy-N-(2-((S)-4-carboxy-4-(17-carboxyhe ptadecanamido)butanamido)ethyl)-N,N-dimethyl-2,11,20-trioxo -6,9,15,18-tetraoxa-3,12,21-triazahexacosan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 170 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note (S)-2-amino-8,48-dioxo-11,14,17,20,23,26,29,32,35,38,41,44- dodecaoxa-7,47-diazapentahexacontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXXLXG

SEQ ID NO: 171 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXXLXG

SEQ ID NO: 172 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXXLXG

SEQ ID NO: 173 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 174 - protein, 14 aa, synthetic construct
  REGION 1..14: note = Modified peptide:
  SITE 1: note = C-terminal is: (S)-22-carboxy-1,10,19,24-tetraoxo-3,6,12,15-tetraoxa-9,18, 23-triazahentetracontan-41-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXKNXG

SEQ ID NO: 175 - protein, 14 aa, synthetic construct
  REGION 1..14: note = Modified peptide:
  SITE 1: note = C-terminal is: Acetyl
  MOD_RES 1: note (2S,27R)-27-amino-2-((S)-2,3-bis(10-(3-carboxyphenoxy)decan amido)propanamido)-5,21-dioxo-9,12,15,18-tetraoxa-6,22-diaz aoctacosanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 176 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 2-naphthylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 177 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  MOD_RES 14: note (2S,29S)-29-amino-5,14,23-trioxo-2-stearamido-9,12,18,21-te traoxa-6,15,24-triazatriacontanedioic acid
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXX

SEQ ID NO: 178 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 179 - protein, 13 aa, synthetic construct
  REGION 1..13: note = Modified peptide:
  SITE 1: note = C-terminal is: Acetyl
  MOD_RES 1: note = L-penicillamine
  MOD_RES 2: note = K(PEG2PEG2-gEC16OH)
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Disulfid - Cyclic bond: L-penicillamine to L-penicillamine
XXTWKXXXXENXG

SEQ ID NO: 180 - protein, 13 aa, synthetic construct
  REGION 1..13: note = Modified peptide:
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXENXG

SEQ ID NO: 181 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXAAXG

SEQ ID NO: 182 - protein, 14 aa, synthetic construct
  REGION 1..14: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXX

SEQ ID NO: 183 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid  bond
XATWKXXXXAAXG

SEQ ID NO: 184 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXELXG

SEQ ID NO: 185 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXXELXG

SEQ ID NO: 186 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 2-naphthylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXELXG

SEQ ID NO: 187 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-25-carboxy-4, 13,22,27-tetraoxo-6,9,15,18-tetraoxa-3,12,21,26-tetraazadot etracontan-42-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 188 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-25-carboxy-4, 13,22,27-tetraoxo-6,9,15,18-tetraoxa-3,12,21,26-tetraazatet ratetracontan-44-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 189 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-4,20,36-triox o-39-palmitamido-7,10,13,16,23,26,29,32-octaoxa-3,19,35-tri azatetracontan-40-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 190 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XATWKXXXXAAXG

SEQ ID NO: 191 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-4,44-dioxo-47 -palmitamido-7,10,13,16,19,22,25,28,31,34,37,40-dodecaoxa-3 ,43-diazaoctatetracontan-48-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 192 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXXKLXG

SEQ ID NO: 193 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 11: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXKXXG

SEQ ID NO: 194 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 11: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXXXXKXXG

SEQ ID NO: 195 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 196 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-39-carboxy-4, 20,36,41-tetraoxo-7,10,13,16,23,26,29,32-octaoxa-3,19,35,40 -tetraazaoctapentacontan-58-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 197 - protein, 13 aa, synthetic construct
  REGION 1..13: note = Modified peptide:
  SITE 1: note = C-terminal is: Acetyl
  MOD_RES 1: note = L-penicillamine
  MOD_RES 3: note (S)-2-amino-8,48-dioxo-11,14,17,20,23,26,29,32,35,38,41,44- dodecaoxa-7,47-diazapentahexacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLXWKXXXXKLXG

SEQ ID NO: 198 - protein, 13 aa, synthetic construct
  REGION 1..13: note = Modified peptide:
  SITE 1: note = C-terminal is: Acetyl
  MOD_RES 1: note = L-penicillamine
  MOD_RES 3: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLXWKXXXXKLXG

SEQ ID NO: 199 - protein, 13 aa, synthetic construct
  REGION 1..13: note = Modified peptide:
  SITE 1: note = C-terminal is: Acetyl
  MOD_RES 1: note = L-penicillamine
  MOD_RES 3: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLXWKXXXXKLXG

SEQ ID NO: 200 - protein, 13 aa, synthetic construct
  REGION 1..13: note = Modified peptide:
  SITE 1: note = C-terminal is: Acetyl
  MOD_RES 1: note = L-penicillamine
  MOD_RES 2: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKLXG

SEQ ID NO: 201 - protein, 13 aa, synthetic construct
  REGION 1..13: note = Modified peptide:
  SITE 1: note = C-terminal is: Acetyl
  MOD_RES 1: note = L-penicillamine
  MOD_RES 2: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKLXG

SEQ ID NO: 202 - protein, 14 aa, synthetic construct
  REGION 1..14: note = Modified peptide:
  SITE 1: note = C-terminal is: Acetyl
  MOD_RES 1: note (R)-2-amino-8,48-dioxo-11,14,17,20,23,26,29,32,35,38,41,44- dodecaoxa-7,47-diazapentahexacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 203 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note (S)-1-(4-((S)-2-amino-2-carboxyethyl)phenoxy)-47-carboxy-4, 44,49-trioxo-7,10,13,16,19,22,25,28,31,34,37,40-dodecaoxa-3 ,43,48-triazahexahexacontan-66-oic acid
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKLXG

SEQ ID NO: 204 - protein, 13 aa, synthetic construct
  REGION 1..13: note = Modified peptide:
  SITE 1: note = C-terminal is: Acetyl
  MOD_RES 1: note = L-penicillamine
  MOD_RES 2: note (S)-2-amino-8,48-dioxo-11,14,17,20,23,26,29,32,35,38,41,44- dodecaoxa-7,47-diazapentahexacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XXTWKXXXXKLXG

SEQ ID NO: 205 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXXLLXG

SEQ ID NO: 206 - protein, 14 aa, synthetic construct
  REGION 1..14: note = Modified peptide:
  SITE 1: note = C-terminal is: Acetyl
  MOD_RES 1: note (2S,51R)-51-amino-5,45-dioxo-2-palmitamido-9,12,15,18,21,24 ,27,30,33,36,39,42-dodecaoxa-6,46-diazadopentacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXLLXG

SEQ ID NO: 207 - protein, 14 aa, synthetic construct
  REGION 1..14: note = Modified peptide:
  SITE 1: note = C-terminal is: Acetyl
  MOD_RES 1: note (1R,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXLLXG

SEQ ID NO: 208 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-2-amino-8,48-dioxo-11,14,17,20,23,26,29,32,35,38,41,44- dodecaoxa-7,47-diazapentahexacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 209 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-2-amino-8,24-dioxo-11,14,17,20-tetraoxa-7,23-diazahente tracontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 210 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = K(IsoGlu_C18_Diacid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 211 - protein, 14 aa, synthetic construct
  REGION 1..14: note = Modified peptide:
  SITE 1: note = C-terminal is: Acetyl
  MOD_RES 1: note (R)-2-amino-8,24-dioxo-11,14,17,20-tetraoxa-7,23-diazahente tracontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 212 - protein, 14 aa, synthetic construct
  REGION 1..14: note = Modified peptide:
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 213 - protein, 14 aa, synthetic construct
  REGION 1..14: note = Modified peptide:
  SITE 1: note = C-terminal is: Acetyl
  MOD_RES 1: note (1R,26S)-1-amino-7,23,28-trioxo-10,13,16,19-tetraoxa-6,22,2 7-triazatetratetracontane-1,26,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 214 - protein, 14 aa, synthetic construct
  REGION 1..14: note = Modified peptide:
  SITE 1: note = C-terminal is: Acetyl
  MOD_RES 1: note (2S,51R)-51-amino-5,45-dioxo-2-palmitamido-9,12,15,18,21,24 ,27,30,33,36,39,42-dodecaoxa-6,46-diazadopentacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 215 - protein, 14 aa, synthetic construct
  REGION 1..14: note = Modified peptide:
  SITE 1: note = C-terminal is: Acetyl
  MOD_RES 1: note (1R,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-methoxyphenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXXXXKLXG

SEQ ID NO: 216 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-2-amino-8,48-dioxo-11,14,17,20,23,26,29,32,35,38,41,44- dodecaoxa-7,47-diazapentahexacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 217 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-2-amino-8,24-dioxo-11,14,17,20-tetraoxa-7,23-diazahente tracontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 218 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 219 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXAAXG

SEQ ID NO: 220 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-5,14,23-trioxo-2-palmitamido-9,12,18,21-t etraoxa-6,15,24-triazatriacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 221 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (2S,27S)-27-amino-5,21-dioxo-2-palmitamido-9,12,15,18-tetra oxa-6,22-diazaoctacosanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 222 - protein, 14 aa, synthetic construct
  REGION 1..14: note = Modified peptide:
  SITE 1: note = C-terminal is: Acetyl
  MOD_RES 1: note (2R,5S,32R)-32-amino-32-carboxy-5-(17-carboxyheptadecanamid o)-2-(carboxymethyl)-N,N,N-trimethyl-4,8,17,26-tetraoxo-12, 15,21,24-tetraoxa-3,9,18,27-tetraazadotriacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 223 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XATWKXXXXKAXG

SEQ ID NO: 224 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,26S)-1-amino-7,23,28-trioxo-10,13,16,19-tetraoxa-6,22,2 7-triazatetratetracontane-1,26,44-tricarboxylic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXKLXG

SEQ ID NO: 225 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-20-amino-14-oxo-2,5,8,11-tetraoxa-15-azahenicosan-21-oi c acid
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWXXFXLLNXG

SEQ ID NO: 226 - protein, 13 aa, synthetic construct
  REGION 1..13: note = Modified peptide:
  SITE 1: note = C-terminal is: 2,5,8,11-tetraoxatetradecan-14-al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWKXFXLLNXG

SEQ ID NO: 227 - protein, 14 aa, synthetic construct
  REGION 1..13: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (1S,28S)-1-amino-7,16,25,30-tetraoxo-9,12,18,21-tetraoxa-6, 15,24,29-tetraazatetratetracontane-1,28,44-tricarboxylic acid
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 228 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (S)-20-amino-14-oxo-2,5,8,11-tetraoxa-15-azahenicosan-21-oi c acid
  MOD_RES 6: note = L-penicillamine
  MOD_RES 8: note = 2-naphthylalanine
  MOD_RES 9: note = alpha-methylleucine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXFXLLNXG

SEQ ID NO: 229 - protein, 14 aa, synthetic construct
  REGION 1..14: note = Modified peptide:
  SITE 1: note = C-terminal is: Acetyl
  MOD_RES 1: note (S)-20-amino-14-oxo-2,5,8,11-tetraoxa-15-azahenicosan-21-oi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXFXLLNXG

SEQ ID NO: 230 - protein, 14 aa, synthetic construct
  REGION 1..14: note = Modified peptide:
  SITE 1: note = C-terminal is: Acetyl
  MOD_RES 1: note (S)-20-amino-14-oxo-2,5,8,11-tetraoxa-15-azahenicosan-21-oi c acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 9: note = 2-naphthylalanine
  MOD_RES 10: note = alpha-methylleucine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXLTWKXFXLLNXG

SEQ ID NO: 231 - protein, 13 aa, synthetic construct
  REGION 1..13: note = Modified peptide:
  SITE 1: note = C-terminal is: N-(15-oxo-3,6,9,12-tetraoxapentadecyl)decanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 232 - protein, 13 aa, synthetic construct
  REGION 1..13: note = Modified peptide:
  SITE 1: note = C-terminal is: N-(15-oxo-3,6,9,12-tetraoxapentadecyl)dodecanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 233 - protein, 13 aa, synthetic construct
  REGION 1..13: note = Modified peptide:
  SITE 1: note = C-terminal is: N-(15-oxo-3,6,9,12-tetraoxapentadecyl)octanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 234 - protein, 13 aa, synthetic construct
  REGION 1..13: note = Modified peptide:
  SITE 1: note = C-terminal is: PEG4_Hexyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 235 - protein, 13 aa, synthetic construct
  REGION 1..13: note = Modified peptide:
  SITE 1: note = C-terminal is: N-(2-(2-(3-oxopropoxy)ethoxy)ethyl)palmitamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 236 - protein, 13 aa, synthetic construct
  REGION 1..13: note = Modified peptide:
  SITE 1: note = C-terminal is: N-(2-(2-(3-oxopropoxy)ethoxy)ethyl)palmitamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 237 - protein, 13 aa, synthetic construct
  REGION 1..13: note = Modified peptide:
  SITE 1: note = C-terminal is: N-(2-(2-(3-oxopropoxy)ethoxy)ethyl)dodecanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 238 - protein, 14 aa, synthetic construct
  REGION 1..14: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazatetracontane-1,28,40-tricarboxylic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGK

SEQ ID NO: 239 - protein, 14 aa, synthetic construct
  REGION 1..14: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,27R)-27-amino-5,21-dioxo-2-palmitamido-9,12,15,18-tetra oxa-6,22-diazaoctacosanedioic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 240 - protein, 15 aa, synthetic construct
  REGION 1..15: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazatetratetracontane-1,28,44-tricarboxylic acid
  SITE 15: note = C-terminal is:amido
  REGION 2..7: note = Cyclic bond: L-penicillamine to L-penicillamine
  DISULFID 2..7: note = Disulfid bond
RXNTWKXXXXENXGX

SEQ ID NO: 241 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XATWKXXXXKNXG

SEQ ID NO: 242 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XATWKXXXXKNXG

SEQ ID NO: 243 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XATWKXXXXKAXG

SEQ ID NO: 244 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,26S)-1-amino-7,23,28-trioxo-10,13,16,19-tetraoxa-6,22,2 7-triazatetratetracontane-1,26,44-tricarboxylic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 245 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 246 - protein, 14 aa, synthetic construct
  REGION 1..14: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGK

SEQ ID NO: 247 - protein, 15 aa, synthetic construct
  REGION 1..15: note = Modified peptide:
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is:amido
  REGION 2..7: note = Cyclic bond: L-penicillamine to L-penicillamine
  DISULFID 2..7: note = Disulfid bond
RXNTWKXXXXENXGX

SEQ ID NO: 248 - protein, 14 aa, synthetic construct
  REGION 1..14: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGK

SEQ ID NO: 249 - protein, 14 aa, synthetic construct
  REGION 1..14: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1R,26S)-1-amino-7,23,28-trioxo-10,13,16,19-tetraoxa-6,22,2 7-triazatetratetracontane-1,26,44-tricarboxylic acid
  SITE 14: note = C-terminal is:amido
  REGION 1..6: note = Cyclic bond: L-penicillamine to L-penicillamine
  DISULFID 1..6: note = Disulfid bond
XNTWKXXXXENXGX

SEQ ID NO: 250 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 251 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  SITE 10: note = D-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXKNXG

SEQ ID NO: 252 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: amido
  REGION 1..6: note = Cyclic bond: L-penicillamine to L-penicillamine
  DISULFID 1..6: note = Disulfid bond
XNTWKXXXXENXG

SEQ ID NO: 253 - protein, 13 aa, synthetic construct
  REGION 1..13: note = Modified peptide:
  SITE 1: note = C-terminal is: N-(2-(2-(3-oxopropoxy)ethoxy)ethyl)palmitamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 254 - protein, 13 aa, synthetic construct
  REGION 1..13: note = Modified peptide:
  SITE 1: note = C-terminal is: N-(2-(2-(3-oxopropoxy)ethoxy)ethyl)dodecanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 255 - protein, 13 aa, synthetic construct
  REGION 1..13: note = Modified peptide:
  SITE 1: note = C-terminal is: PEG4_Palm
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 256 - protein, 13 aa, synthetic construct
  REGION 1..13: note = Modified peptide:
  SITE 1: note = C-terminal is: Palm
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 257 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S,51S)-51-amino-5,45-dioxo-2-palmitamido-9,12,15,18,21,24 ,27,30,33,36,39,42-dodecaoxa-6,46-diazadopentacontanedioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 258 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note (S)-4-amino-1-(44-carboxy-41,46-dioxo-4,7,10,13,16,19,22,25 ,28,31,34,37-dodecaoxa-40,45-diazahenhexacontanoyl)piperidi ne-4-carboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXFXXKNXG

SEQ ID NO: 259 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (1S,50S)-1-amino-7,47,52-trioxo-10,13,16,19,22,25,28,31,34, 37,40,43-dodecaoxa-6,46,51-triazaoctahexacontane-1,50,68-tr icarboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 260 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note = Alpha-methyl L-lysine(Peg4_IsoGlu_C18_Diacid)
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 261 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note = Alpha-methyl L-lysine(PEG12_C18_Diacid)
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 262 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 263 - protein, 13 aa, synthetic construct
  REGION 1..13: note = Modified peptide:
  SITE 1: note = C-terminal is: (S)-1,10,19-trioxo-22-stearamido-3,6,12,15-tetraoxa-9,18-di azatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is:amido
  REGION 2..7: note = Cyclic bond: L-penicillamine to L-penicillamine
  DISULFID 2..7: note = Disulfid bond
RXNTWKXXXXENX

SEQ ID NO: 264 - protein, 13 aa, synthetic construct
  REGION 1..13: note = Modified peptide:
  SITE 1: note = C-terminal is:(S)-1,10,19-trioxo-22-stearamido-3,6,12,15-tetraoxa-9,18 -diazatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is:amido
  REGION 2..7: note = Cyclic bond: L-penicillamine to L-penicillamine
  DISULFID 2..7: note = Disulfid bond
RXNTWKXXXXENX

SEQ ID NO: 265 - protein, 14 aa, synthetic construct
  REGION 1..14: note = Modified peptide:
  SITE 1: note = C-terminal is: ac
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
XXNTWKXXXXXNXG

SEQ ID NO: 266 - protein, 13 aa, synthetic construct
  REGION 1..13: note = Modified peptide:
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is:amido
  REGION 2..7: note = Cyclic bond: L-penicillamine to L-penicillamine
  DISULFID 2..7: note = Disulfid bond
XXNTWKXXXXENX

SEQ ID NO: 267 - protein, 13 aa, synthetic construct
  REGION 1..13: note = Modified peptide:
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is:amido
  REGION 2..7: note = Cyclic bond: L-penicillamine to L-penicillamine
  DISULFID 2..7: note = Disulfid bond
XXNTWKXXXXENX

SEQ ID NO: 268 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 269 - protein, 13 aa, synthetic construct
  REGION 1..13: note = Modified peptide:
  SITE 1: note = C-terminal is: Hexyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXLNXG

SEQ ID NO: 270 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note (2S)-29-amino-29-methyl-5,14,23-trioxo-2-palmitamido-9,12,1 8,21-tetraoxa-6,15,24-triazatriacontanedioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 271 - protein, 13 aa, synthetic construct
  REGION 1..13: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note (29S)-2-amino-8,17,26,31-tetraoxo-10,13,19,22-tetraoxa-7,16 ,25,30-tetraazaheptatetracontane-2,29,47-tricarboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 272 - protein, 12 aa, synthetic construct
  REGION 1..12: note = Modified peptide:
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XLTWKXFXLLNX

SEQ ID NO: 273 - protein, 12 aa, synthetic construct
  REGION 1..12: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XLTWXXFXLLNX

SEQ ID NO: 274 - protein, 12 aa, synthetic construct
  REGION 1..12: note = Modified peptide:
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XLTWKXXXLLNX

SEQ ID NO: 275 - protein, 12 aa, synthetic construct
  REGION 1..12: note = Modified peptide:
  SITE 1: note = C-terminal is: Acetyl
  MOD_RES 1: note = L-penicillamine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XLTWXXXXLLNX

SEQ ID NO: 276 - protein, 12 aa, synthetic construct
  REGION 1..12: note = Modified peptide:
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 2: note = alpha-methylasparagine
  MOD_RES 4: note = 7-methyl-L-tryptophan
  MOD_RES 5: note = N6-Acetyl-L-lysine
  MOD_RES 6: note = L-penicillamine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XNTWKXFXLLNX

SEQ ID NO: 277 - protein, 12 aa, synthetic construct
  REGION 1..12: note = Modified peptide:
  SITE 1: note = C-terminal is: Acetyl
  MOD_RES 1: note = L-penicillamine
  MOD_RES 2: note = alpha-methylasparagine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XNTWXXFXLLNX

SEQ ID NO: 278 - protein, 12 aa, synthetic construct
  REGION 1..12: note = Modified peptide:
  SITE 1: note = C-terminal is: 2,5,8,11,14,17,20,23,26,29,32,35-dodecaoxaoctatriacontan-38 -al
  MOD_RES 1: note = L-penicillamine
  MOD_RES 2: note = alpha-methylasparagine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XNTWKXXXLLNX

SEQ ID NO: 279 - protein, 12 aa, synthetic construct
  REGION 1..12: note = Modified peptide:
  SITE 1: note = C-terminal is: Acetyl
  MOD_RES 1: note = L-penicillamine
  MOD_RES 2: note = alpha-methylasparagine
  MOD_RES 4: note = 7-methyl-L-tryptophan
  MOD_RES 5: note (R)-44-amino-38-oxo-2,5,8,11,14,17,20,23,26,29,32,35-dodeca oxa-39-azapentatetracontan-45-oic acid
  MOD_RES 6: note = L-penicillamine
  MOD_RES 7: note = 4-methoxyphenylalanine
  MOD_RES 8: note = 2-naphthylalanine
  MOD_RES 9: note = alpha-methylleucine
  MOD_RES 12: note = NH(2-(pyridin-3-yl)ethyl)
  REGION 1..6: note = Cyclic bond: L-penicillamine to L-penicillamine
  DISULFID 1..6: note = Disulfid bond
XNTWXXXXLLNX

SEQ ID NO: 280 - protein, 13 aa, synthetic construct
  REGION 1..13: note = Modified peptide
  SITE 1: note = C-terminal is: pentanoyl
  SITE 1: note = D-Arginine
  MOD_RES 2: note = L-penicillamine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = bAla
  SITE 13: note = C-terminal is: Carboxamide
  REGION 2..7: note = Cyclic bond: L-penicillamine to L-penicillamine
  DISULFID 2..7: note = Disulfid bond
RXQTWQXXXXENX

SEQ ID NO: 281 - protein, 13 aa, synthetic construct
  REGION 1..13: note = Modified peptide
  SITE 1: note = C-terminal is: Acetyl
  SITE 1: note = D-Arginine
  MOD_RES 2: note = L-penicillamine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-((R)-2-amino-3-mercapto-3-methylbutanoyl)-L-lysine
  MOD_RES 13: note = bAla
  SITE 13: note = C-terminal is: Carboxamide
  REGION 2..7: note = Cyclic bond: L-penicillamine to L-penicillamine
  DISULFID 2..7: note = Disulfid bond
RXQTWQXXXXXNX

SEQ ID NO: 282 - protein, 13 aa, synthetic construct
  REGION 1..13: note = Modified peptide
  SITE 1: note = C-terminal is: pentanoyl
  SITE 1: note = D-Arginine
  MOD_RES 2: note = L-penicillamine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 4-amino-4-carboxy-tetrahydropyran
  SITE 13: note = C-terminal is: Carboxamide
  REGION 2..7: note = Cyclic bond: L-penicillamine to L-penicillamine
  DISULFID 2..7: note = Disulfid bond
RXQTWQXXXXENX

SEQ ID NO: 283 - protein, 13 aa, synthetic construct
  REGION 1..13: note = Modified peptide
  SITE 1: note = C-terminal is: Acetyl
  SITE 1: note = D-Arginine
  MOD_RES 2: note = L-penicillamine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-((R)-2-amino-3-mercapto-3-methylbutanoyl)-L-lysine
  SITE 13: note = C-terminal is: Carboxamide
  REGION 2..7: note = Cyclic bond: L-penicillamine to L-penicillamine
  DISULFID 2..7: note = Disulfid bond
RXQTWQXXXXXNF

SEQ ID NO: 284 - protein, 13 aa, synthetic construct
  REGION 1..13: note = Modified peptide
  SITE 1: note = C-terminal is: pentanoyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = Alpha-methyl L-phenylalanine
  SITE 13: note = C-terminal is: Carboxamide
  REGION 2..7: note = Cyclic bond: L-penicillamine to L-penicillamine
  DISULFID 2..7: note = Disulfid bond
RXNTWKXXXXENX

SEQ ID NO: 285 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 286 - protein, 13 aa, synthetic construct
  REGION 1..13: note = Modified peptide
  SITE 1: note = C-terminal is: Acetyl
  MOD_RES 1: note (2S,29S)-29-amino-5,14,23-trioxo-2-stearamido-9,12,18,21-te traoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is: Carboxamide
  REGION 2..7: note = Cyclic bond: L-penicillamine to L-penicillamine
  DISULFID 2..7: note = Disulfid bond
XXNTWKXXXXENX

SEQ ID NO: 287 - protein, 13 aa, synthetic construct
  REGION 1..13: note = Modified peptide
  SITE 1: note = C-terminal is: Acetyl
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is: Carboxamide
  REGION 2..7: note = Cyclic bond: L-penicillamine to L-penicillamine
  DISULFID 2..7: note = Disulfid bond
XXNTWKXXXXENX

SEQ ID NO: 288 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 289 - protein, 13 aa, synthetic construct
  REGION 1..13: note = Modified peptide
  SITE 1: note = C-terminal is: (S)-22-carboxy-1,10,19,24-tetraoxo-3,6,12,15-tetraoxa-9,18, 23-triazahentetracontan-41-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is: Carboxamide
  REGION 2..7: note = Cyclic bond: L-penicillamine to L-penicillamine
  DISULFID 2..7: note = Disulfid bond
RXNTWKXXXXENX

SEQ ID NO: 290 - protein, 13 aa, synthetic construct
  REGION 1..13: note = Modified peptide
  SITE 1: note = C-terminal is: (S)-1,10,19-trioxo-22-stearamido-3,6,12,15-tetraoxa-9,18-di azatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 1-aminocyclopentane-1-carboxylic acid
  MOD_RES 13: note = 4-amino-4-carboxy-tetrahydropyran
  SITE 13: note = C-terminal is: Carboxamide
  REGION 2..7: note = Cyclic bond: L-penicillamine to L-penicillamine
  DISULFID 2..7: note = Disulfid bond
RXNTWKXXXXENX

SEQ ID NO: 291 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = F(4-Carboxamide)
  MOD_RES 8: note = 2-naphthylalanine
  MOD_RES 9: note 2-amino-2-methyl-8,24-dioxo-11,14,17,20-tetraoxa-7,23-diaza hentetracontanedioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 292 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazaoctatriacontane-1,28,38-tricarboxylic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 293 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazadotetracontane-1,28,42-tricarboxylic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 294 - protein, 14 aa, synthetic construct
  REGION 1..14: note = Modified peptide
  SITE 1: note = C-terminal is: 1PEG2_1PEG2_IsoGlu_C16_Diacid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXKNXG

SEQ ID NO: 295 - protein, 15 aa, synthetic construct
  REGION 1..15: note = Modified peptide
  SITE 1: note = C-terminal is: Acetyl
  MOD_RES 1: note (S)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazaoctatetracontane-1,28,48-tricarboxylic acid
  REGION 2..7: note = Cyclic bond: L-penicillamine to L-penicillamine
  DISULFID 2..7: note = Disulfid bond
XXNTWKXXXXENXGX

SEQ ID NO: 296 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
RXETWKXXXXENXGX

SEQ ID NO: 297 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazahentetracontan-41-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXNTWKXXXXKNXG

SEQ ID NO: 298 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (51S)-2-amino-8,48,53-trioxo-11,14,17,20,23,26,29,32,35,38, 41,44-dodecaoxa-7,47,52-triazanonahexacontane-2,51,69-trica rboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 299 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazanonatriacontan-39-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXG

SEQ ID NO: 300 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = K(PEG2PEG2-gEC16OH)
  SITE 14: note = C-terminal is:amido
  REGION 2..7: note = Cyclic bond: L-penicillamine to L-penicillamine
  DISULFID 2..7: note = Disulfid bond
RXNTWKXXXXENXX

SEQ ID NO: 301 - protein, 14 aa, synthetic construct
  REGION 1..14: note = Modified peptide
  SITE 1: note = C-terminal is: HOC20gEPEG2PEG2CO
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXNTWKXXXXENXG

SEQ ID NO: 302 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXXTWKXXXXENXG

SEQ ID NO: 303 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note (2S)-51-amino-51-methyl-5,45-dioxo-2-palmitamido-9,12,15,18 ,21,24,27,30,33,36,39,42-dodecaoxa-6,46-diazadopentacontane dioic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXKNXG

SEQ ID NO: 304 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note (29S)-2-amino-8,17,26,31-tetraoxo-10,13,19,22-tetraoxa-7,16 ,25,30-tetraazaheptatetracontane-2,29,47-tricarboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 305 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note (29S)-2-amino-8,17,26,31-tetraoxo-10,13,19,22-tetraoxa-7,16 ,25,30-tetraazapentatetracontane-2,29,45-tricarboxylic acid
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 306 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazaoctatriacontane-1,28,38-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 307 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (3S,30S)-9,18,27,32-tetraoxo-11,14,20,23-tetraoxa-2,8,17,26 ,31-pentaazaoctatetracontane-3,30,48-tricarboxylic acid
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXX

SEQ ID NO: 308 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazahentetracontan-41-oic acid
  MOD_RES 1: note = dKSP6
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXNTWKXXXXENXG

SEQ ID NO: 309 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note (S)-1-(4-((S)-2-amino-2-carboxyethyl)phenoxy)-25-carboxy-4, 13,22,27-tetraoxo-6,9,15,18-tetraoxa-3,12,21,26-tetraazatet ratetracontan-44-oic acid
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
XXNTWKXXXXENXG

SEQ ID NO: 310 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazaoctatriacontane-1,28,38-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXKNXG

SEQ ID NO: 311 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXNTWXXXXXENXG

SEQ ID NO: 312 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 313 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazaoctatriacontane-1,28,38-tricarboxylic acid
  MOD_RES 2: note = L-penicillamine
  MOD_RES 3: note (1S,28S)-1-amino-7,16,25,30-tetraoxo-9,12,18,21-tetraoxa-6, 15,24,29-tetraazaoctatriacontane-1,28,38-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXXTWKXXXXKNXG

SEQ ID NO: 314 - protein, 14 aa, synthetic construct
  REGION 1..14: note = Modified peptide
  SITE 1: note = C-terminal is: Acetyl
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 2..7: note = Disulfid bond
  DISULFID 3..8: note = Disulfid bond
XXETWKXXXXKNXG

SEQ ID NO: 315 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
XXETWKXXXXKNXG

SEQ ID NO: 316 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 2..7: note = Disulfid bond
  DISULFID 3..8: note = Disulfid bond
XXETWKXXXXKNXG

SEQ ID NO: 317 - protein, 14 aa, synthetic construct
  REGION 1..14: note = Modified peptide
  SITE 1: note = C-terminal is: Acetyl
  MOD_RES 1: note (1R,28S)-1-amino-7,16,25,30-tetraoxo-9,12,18,21-tetraoxa-6, 15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 2..7: note = Disulfid bond
  DISULFID 3..8: note = Disulfid bond
XXETWKXXXXKNXG

SEQ ID NO: 318 - protein, 15 aa, synthetic construct
  REGION 1..15: note = Modified peptide
  SITE 1: note = C-terminal is: Acetyl
  SITE 1: note = D-Ornithine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazaoctatetracontane-1,28,48-tricarboxylic acid
  REGION 2..7: note = Cyclic bond: L-penicillamine to L-penicillamine
  DISULFID 2..7: note = Disulfid bond
XXNTWKXXXXENXGX

SEQ ID NO: 319 - protein, 13 aa, synthetic construct
  REGION 1..13: note = Modified peptide
  SITE 1: note = C-terminal is: N-(15-oxo-3,6,9,12-tetraoxapentadecyl)dodecanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 320 - protein, 14 aa, synthetic construct
  REGION 1..14: note = Modified peptide
  SITE 1: note = C-terminal is: Acetyl
  MOD_RES 4: note = 7-methyl-L-tryptophan
  MOD_RES 5: note = N6-Acetyl-L-lysine
  MOD_RES 6: note = alpha-methylcysteine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is: Carboxamide
  REGION 1..6: note = Cyclic bond: C to C
  DISULFID 1..6: note = Disulfid bond
CNTWKCXXXENXGX

SEQ ID NO: 321 - protein, 15 aa, synthetic construct
  REGION 1..15: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note = N6-Acetyl-L-lysine
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: Abu to C
  DISULFID 2..7: note = Disulfid bond
RXNTWKCXXXENXGX

SEQ ID NO: 322 - protein, 13 aa, synthetic construct
  REGION 1..13: note = Modified peptide
  SITE 1: note = C-terminal is: N-(15-oxo-3,6,9,12-tetraoxapentadecyl)octanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 323 - protein, 13 aa, synthetic construct
  REGION 1..13: note = Modified peptide
  SITE 1: note = C-terminal is: N-(15-oxo-3,6,9,12-tetraoxapentadecyl)hexanamide
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXENXG

SEQ ID NO: 324 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXENXG

SEQ ID NO: 325 - protein, 15 aa, synthetic construct
  REGION 1..15: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: Abu to L-penicillamine
  DISULFID 2..7: note = Disulfid bond
RXNTWKXXXXENXGX

SEQ ID NO: 326 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is:amido
  REGION 2..7: note = Cyclic bond: L-penicillamine to L-penicillamine
  DISULFID 2..7: note = Disulfid bond
RXXTWKXXXXENXG

SEQ ID NO: 327 - protein, 13 aa, synthetic construct
  REGION 1..13: note = Modified peptide
  SITE 1: note = C-terminal is: 7-aminoheptanoic acid
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 328 - protein, 14 aa, synthetic construct
  REGION 1..14: note = Modified peptide
  SITE 1: note = C-terminal is: N,N,N-trimethyl-2-(2-(3-oxopropoxy)ethoxy)ethan-1-aminium
  MOD_RES 1: note (2S,48R)-48-amino-2-dodecanamido-5,14,23,32,41-pentaoxo-9,1 2,18,21,27,30,36,39-octaoxa-6,15,24,33,42-pentaazanonatetra contanedioic acid
  MOD_RES 2: note = L-penicillamine
  MOD_RES 3: note = N,N-dimethylasparagine
  MOD_RES 5: note = 7-methyl-L-tryptophan
  MOD_RES 6: note = N6-Acetyl-L-lysine
  MOD_RES 7: note = L-penicillamine
  MOD_RES 8: note (S)-5-(4-(2-amino-2-carboxyethyl)phenoxy)-N,N,N-trimethylpe ntan-1-aminium
  MOD_RES 9: note = 2-naphthylalanine
  MOD_RES 10: note = 4-amino-4-carboxy-tetrahydropyran
  MOD_RES 11: note = K(NMeAc)
  MOD_RES 13: note = 3-(2-pyridyl)-alanine
  MOD_RES 14: note (2S)-48-amino-2-dodecanamido-48-methyl-5,14,23,32,41-pentao xo-9,12,18,21,27,30,36,39-octaoxa-6,15,24,33,42-pentaazanon atetracontanedioic acid
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXXNXX

SEQ ID NO: 329 - protein, 13 aa, synthetic construct
  REGION 1..13: note = Modified peptide
  SITE 1: note = C-terminal is: 5Ava
  MOD_RES 1: note = Abu
  MOD_RES 5: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: Abu to C
  DISULFID 1..6: note = Disulfid bond
XNTWXCXXXENXG

SEQ ID NO: 330 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazahentetracontan-41-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
RXETWKXXXXENXG

SEQ ID NO: 331 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-5,14,23-trioxo-2-palmitamido-9,12,18,21-t etraoxa-6,15,24-triazatriacontanedioic acid
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XLTWXXXXXLLXG

SEQ ID NO: 332 - protein, 14 aa, synthetic construct
  REGION 1..14: note = Modified peptide
  SITE 1: note = C-terminal is: Acetyl
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
XXETWKXXXXENXG

SEQ ID NO: 333 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note 16-(((S)-3-(((S)-5-amino-5-carboxypentyl)amino)-2-((15-carb oxypentadecyl)amino)-3-oxopropyl)amino)-16-oxohexadecanoic acid
  MOD_RES 12: note = 3-(2-pyridyl)-alanine
  MOD_RES 13: note = MeGly
  SITE 13: note = C-terminal is:amido
  REGION 1..6: note = Cyclic bond: L-penicillamine to L-penicillamine
  DISULFID 1..6: note = Disulfid bond
XNTWKXXXXXNXG

SEQ ID NO: 334 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
RXETWXXXXXENXG

SEQ ID NO: 335 - protein, 13 aa, synthetic construct
  REGION 1..13: note = Modified peptide
  SITE 1: note = C-terminal is: 3-(2-(2-aminoethoxy)ethoxy)propanal
  MOD_RES 1: note = L-penicillamine
  MOD_RES 4: note = 7-methyl-L-tryptophan
  MOD_RES 5: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 336 - protein, 14 aa, synthetic construct
  REGION 1..14: note = Modified peptide
  SITE 1: note = C-terminal is: Acetyl
  MOD_RES 1: note (2S,17S,44R)-44-amino-17,44-dicarboxy-2-(carboxymethyl)-N,N ,N-trimethyl-4,15,20,29,38-pentaoxo-24,27,33,36-tetraoxa-3, 16,21,30,39-pentaazatetratetracontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 337 - protein, 14 aa, synthetic construct
  REGION 1..14: note = Modified peptide
  SITE 1: note = C-terminal is: Acetyl
  MOD_RES 1: note (2S,17S,44R)-44-amino-17,44-dicarboxy-2-(carboxymethyl)-N,N ,N-trimethyl-4,15,20,29,38-pentaoxo-24,27,33,36-tetraoxa-3, 16,21,30,39-pentaazatetratetracontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 338 - protein, 14 aa, synthetic construct
  REGION 1..14: note = Modified peptide
  SITE 1: note = C-terminal is: Acetyl
  MOD_RES 1: note (2S,5S,32R)-32-amino-32-carboxy-2-(carboxymethyl)-5-dodecan amido-N,N,N-trimethyl-4,8,17,26-tetraoxo-12,15,21,24-tetrao xa-3,9,18,27-tetraazadotriacontan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 339 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (S)-26-amino-26-carboxy-N,N-dimethyl-2,11,20-trioxo-N-(2-te tradecanamidoethyl)-6,9,15,18-tetraoxa-3,12,21-triazahexaco san-1-aminium
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 340 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 3: note = asparagine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
RXXTWKXXXXENXGX

SEQ ID NO: 341 - protein, 14 aa, synthetic construct
  REGION 1..14: note = Modified peptide
  SITE 1: note = C-terminal is: Acetyl
  MOD_RES 1: note = L-penicillamine
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazaoctatetracontane-1,28,48-tricarboxylic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXKNXGX

SEQ ID NO: 342 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  MOD_RES 14: note = PEG2
  SITE 14: note = C-terminal is: 2-(2-(2-aminoethoxy)ethoxy)-N-(2-(2-(2-oxoethoxy)ethoxy)eth yl)acetamide
  REGION 1..6: note = Cyclic bond: L-penicillamine to L-penicillamine
  DISULFID 1..6: note = Disulfid bond
XNTWKXXXXKNXGX

SEQ ID NO: 343 - protein, 14 aa, synthetic construct
  REGION 1..14: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWXXXXXENXG

SEQ ID NO: 344 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (R)-2-(4-(((S)-5-amino-5-carboxypentyl)amino)-4-oxobutanami do)-3-carboxy-N,N,N-trimethylpropan-1-aminium
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXXTWXXXXXENXG

SEQ ID NO: 345 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  SITE 6: note = D-Lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXXTWKXXXXENXG

SEQ ID NO: 346 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (R)-2-(4-(((S)-5-amino-5-carboxypentyl)amino)-4-oxobutanami do)-3-carboxy-N,N,N-trimethylpropan-1-aminium
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazaoctatetracontane-1,28,48-tricarboxylic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXXNXGX

SEQ ID NO: 347 - protein, 15 aa, synthetic construct
  REGION 1..15: note = Modified peptide
  SITE 1: note = C-terminal is: 2-chloro-N-(15-oxo-3,6,9,12-tetraoxapentadecyl)acetamide
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXENXGX

SEQ ID NO: 348 - protein, 15 aa, synthetic construct
  REGION 1..15: note = Modified peptide
  SITE 1: note = C-terminal is: Acetyl
  MOD_RES 1: note = (R)-6-amino-6-carboxy-N,N,N-trimethylhexan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  REGION 2..7: note = Cyclic bond: L-penicillamine to L-penicillamine
  SITE 2..7: note = Disulfid bond
KXNTWKXXXXENXGX

SEQ ID NO: 349 - protein, 15 aa, synthetic construct
  REGION 1..15: note = Modified peptide
  SITE 1: note = C-terminal is: Acetyl
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  REGION 2..7: note = Cyclic bond: L-penicillamine to L-penicillamine
  SITE 2..7: note = Disulfid bond
XXNTWKXXXXENXGX

SEQ ID NO: 350 - protein, 15 aa, synthetic construct
  REGION 1..15: note = Modified peptide
  SITE 1: note = C-terminal is: Acetyl
  SITE 1: note = D- Ornithine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  REGION 2..7: note = Cyclic bond: L-penicillamine to L-penicillamine
  DISULFID 2..7: note = Disulfid bond
XXNTWKXXXXENXGX

SEQ ID NO: 351 - protein, 14 aa, synthetic construct
  REGION 1..14: note = Modified peptide
  SITE 1: note = C-terminal is: succiniccarn
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXENXG

SEQ ID NO: 352 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = d4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXXTWKXXXXENXG

SEQ ID NO: 353 - protein, 14 aa, synthetic construct
  REGION 1..14: note = Modified peptide
  SITE 1: note = C-terminal is: Acetyl
  MOD_RES 1: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazatetratetracontane-1,28,44-tricarboxylic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXXNXG

SEQ ID NO: 354 - protein, 15 aa, synthetic construct
  REGION 1..15: note = Modified peptide
  SITE 1: note = C-terminal is: Acetyl
  MOD_RES 1: note (S)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  REGION 2..7: note = Cyclic bond: L-penicillamine to L-penicillamine
XXNTWKXXXXENXGX

SEQ ID NO: 355 - protein, 14 aa, synthetic construct
  REGION 1..14: note = Modified peptide
  SITE 1: note = C-terminal is: (S)-22-dodecanamido-1,10,19-trioxo-3,6,12,15-tetraoxa-9,18- diazatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-dodecanamido-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXXNXG

SEQ ID NO: 356 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXENXG

SEQ ID NO: 357 - protein, 14 aa, synthetic construct
  REGION 1..14: note = Modified peptide
  SITE 1: note = C-terminal is: N,N,N-trimethyl-2-(2-(3-oxopropoxy)ethoxy)ethan-1-aminium
  SITE 1: note = D-Arginine
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXENXG

SEQ ID NO: 358 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXENXGX

SEQ ID NO: 359 - protein, 14 aa, synthetic construct
  REGION 1..14: note = Modified peptide
  SITE 1: note = C-terminal is: N,N,N-trimethyl-2-(2-(3-oxopropoxy)ethoxy)ethan-1-aminium
  SITE 1: note = D-Arginine
  MOD_RES 2: note = L-penicillamine
  MOD_RES 3: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXXTWKXXXXENXG

SEQ ID NO: 360 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 4: note = 7-methyl-L-tryptophan
  MOD_RES 5: note (2S,29S)-29-amino-2-dodecanamido-5,14,23-trioxo-9,12,18,21- tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 361 - protein, 13 aa, synthetic construct
  REGION 1..13: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 4: note = 7-methyl-L-tryptophan
  MOD_RES 5: note (2S,29S)-29-amino-5,14,23-trioxo-2-tetradecanamido-9,12,18, 21-tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 362 - protein, 14 aa, synthetic construct
  REGION 1..14: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note (2S,29R)-29-amino-5,14,23-trioxo-2-tetradecanamido-9,12,18, 21-tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXENXG

SEQ ID NO: 363 - protein, 14 aa, synthetic construct
  REGION 1..14: note = Modified peptide
  SITE 1: note = C-terminal is: (1S,28S)-1-amino-7,16,25,30-tetraoxo-9,12,18,21-tetraoxa-6, 15,24,29-tetraazatetratetracontane-1,28,44-tricarboxylic acid
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N,N,N-trimethyllysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N,N,N-trimethyllysine
  MOD_RES 13: note = 3-(2-pyridyl)-alanine
  MOD_RES 14: note = MeGly
  SITE 14: note = C-terminal is: dimethylamido
  REGION 2..7: note = Cyclic bond: L-penicillamine to L-penicillamine
  REGION 3..8: note = Cyclic bond: E to 4-(2-aminoethoxy)-L-phenylalanine
  DISULFID 3..8: note = Disulfid bond
  DISULFID 2..7: note = Disulfid bond
XXETWKXXXXKNXG

SEQ ID NO: 364 - protein, 12 aa, synthetic construct
  REGION 1..12: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = L-penicillamine
  MOD_RES 6: note = 4-(2-aminoethoxy)-L-phenylalanine
  MOD_RES 7: note = 2-naphthylalanine
  MOD_RES 8: note = 4-amino-4-carboxy-tetrahydropyran
  MOD_RES 9: note (2S,29S)-29-amino-2-dodecanamido-5,14,23-trioxo-9,12,18,21- tetraoxa-6,15,24-triazatriacontanedioic acid
  MOD_RES 11: note = 3-(2-pyridyl)-alanine
  MOD_RES 12: note = MeGly
  SITE 12: note = C-terminal is: Carboxamide
  REGION 1..6: note = Cyclic bond: L-penicillamine to L-penicillamine
  DISULFID 1..6: note = Disulfid bond
XNTWXXXXXNXG

SEQ ID NO: 365 - protein, 14 aa, synthetic construct
  REGION 1..14: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note d(2S,29S)-29-amino-2-dodecanamido-5,14,23-trioxo-9,12,18,21 -tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXENXG

SEQ ID NO: 366 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid  bond
XNTWKXXXXENXG

SEQ ID NO: 367 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-2-dodecanamido-5,14,23-trioxo-9,12,18,21- tetraoxa-6,15,24-triazatriacontanedioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 368 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazatritetracontan-43-oic acid
  MOD_RES 1: note (R)-2-(4-(((R)-5-amino-5-carboxypentyl)amino)-4-oxobutanami do)-3-carboxy-N,N,N-trimethylpropan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = K(NMeAc)
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
XXNTWKXXXXXNXG

SEQ ID NO: 369 - protein, 13 aa, synthetic construct
  REGION 1..13: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXENXG

SEQ ID NO: 370 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 2: note (2S,29S)-29-amino-2-dodecanamido-5,14,23-trioxo-9,12,18,21- tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 371 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  MOD_RES 14: note (2S,29S)-29-amino-2-dodecanamido-5,14,23-trioxo-9,12,18,21- tetraoxa-6,15,24-triazatriacontanedioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXKNXGX

SEQ ID NO: 372 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazatritriacontan-33-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (1S,28S)-1-amino-7,16,25,30-tetraoxo-9,12,18,21-tetraoxa-6, 15,24,29-tetraazaoctatriacontane-1,28,38-tricarboxylic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXXNXG

SEQ ID NO: 373 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (1S,28S)-1-amino-7,16,25,30-tetraoxo-9,12,18,21-tetraoxa-6, 15,24,29-tetraazaoctatriacontane-1,28,38-tricarboxylic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 374 - protein, 13 aa, synthetic construct
  REGION 1..13: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 2: note (2S,29S)-29-amino-5,14,23-trioxo-2-tetradecanamido-9,12,18, 21-tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 375 - protein, 14 aa, synthetic construct
  REGION 1..14: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-5,14,23-trioxo-2-tetradecanamido-9,12,18, 21-tetraoxa-6,15,24-triazatriacontanedioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 376 - protein, 14 aa, synthetic construct
  REGION 1..14: note = Modified peptide
  SITE 1: note = C-terminal is: Acetyl
  MOD_RES 1: note (2S,29R)-29-amino-2-dodecanamido-5,14,23-trioxo-9,12,18,21- tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXENXG

SEQ ID NO: 377 - protein, 14 aa, synthetic construct
  REGION 1..14: note = Modified peptide
  SITE 1: note = C-terminal is: Acetyl
  MOD_RES 1: note (2S,29R)-29-amino-5,14,23-trioxo-2-tetradecanamido-9,12,18, 21-tetraoxa-6,15,24-triazatriacontanedioic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXENXG

SEQ ID NO: 378 - protein, 13 aa, synthetic construct
  REGION 1..13: note = Modified peptide
  SITE 1: note = C-terminal is: 6-aminohexanoic acid
  MOD_RES 1: note = Abu
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note (3S,30S)-9,18,27,32-tetraoxo-11,14,20,23-tetraoxa-2,8,17,26 ,31-pentaazaoctatetracontane-3,30,48-tricarboxylic acid
  SITE 13: note = C-terminal is: Carboxamide
  REGION 1..6: note = Cyclic bond: Abu to C
  DISULFID 1..6: note = Disulfid bond
XNTWQCXXXENXX

SEQ ID NO: 379 - protein, 14 aa, synthetic construct
  REGION 1..14: note = Modified peptide
  SITE 1: note = C-terminal is: (S)-22-dodecanamido-1,10,19-trioxo-3,6,12,15-tetraoxa-9,18- diazatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXG

SEQ ID NO: 380 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = (S)-2-amino-3-(4-carbamoylphenyl)propanoic acid
  MOD_RES 8: note = 2-naphthylalanine
  MOD_RES 9: note = Alpha-methyl L-lysine(PEG12gEC16)
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 381 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = Alpha-methyl L-lysine(PEG12gEC16)
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXKNXG

SEQ ID NO: 382 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-2-dodecanamido-5,14,23-trioxo-9,12,18,21- tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-dodecanamido-5,14,23-trioxo-9,12,18,21- tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXXNXG

SEQ ID NO: 383 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-dodecanamido-5,14,23-trioxo-9,12,18,21- tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 384 - protein, 13 aa, synthetic construct
  REGION 1..13: note = Modified peptide
  SITE 1: note = C-terminal is: Acetyl
  MOD_RES 1: note = L-penicillamine
  MOD_RES 5: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXKNXG

SEQ ID NO: 385 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXKNXG

SEQ ID NO: 386 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-2-dodecanamido-5,14,23-trioxo-9,12,18,21- tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 387 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-dodecanamido-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXXNXG

SEQ ID NO: 388 - protein, 14 aa, synthetic construct
  REGION 1..14: note = Modified peptide
  SITE 1: note = C-terminal is: (S)-22-dodecanamido-1,10,19-trioxo-3,6,12,15-tetraoxa-9,18- diazatricosan-23-oic acid
  SITE 1: note = D-Arginine
  MOD_RES 2: note = L-penicillamine
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXENXG

SEQ ID NO: 389 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXENXG

SEQ ID NO: 390 - protein, 13 aa, synthetic construct
  REGION 1..13: note = Modified peptide
  SITE 1: note = C-terminal is: (S)-22-dodecanamido-1,10,19-trioxo-3,6,12,15-tetraoxa-9,18- diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine(G)
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXENXG

SEQ ID NO: 391 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-dodecanamido-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXXNXG

SEQ ID NO: 392 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-5,14,23-trioxo-2-tetradecanamido-9,12,18, 21-tetraoxa-6,15,24-triazatriacontanedioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 393 - protein, 14 aa, synthetic construct
  REGION 1..14: note = Modified peptide
  SITE 1: note = C-terminal is: (S)-22-dodecanamido-1,10,19-trioxo-3,6,12,15-tetraoxa-9,18- diazatricosan-23-oic acid
  SITE 1: note = D-Arginine
  MOD_RES 2: note = L-penicillamine
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
RXNTWXXXXXENXG

SEQ ID NO: 394 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  MOD_RES 14: note (2S,29S)-29-amino-5,14,23-trioxo-2-tetradecanamido-9,12,18, 21-tetraoxa-6,15,24-triazatriacontanedioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXKNXGX

SEQ ID NO: 395 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-5,14,23-trioxo-2-tetradecanamido-9,12,18, 21-tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 396 - protein, 14 aa, synthetic construct
  REGION 1..14: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note = N6-Acetyl-L-lysine
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (2S,29S)-29-amino-2-dodecanamido-5,14,23-trioxo-9,12,18,21- tetraoxa-6,15,24-triazatriacontanedioic acid
  MOD_RES 13: note = 3-(2-pyridyl)-alanine
  MOD_RES 14: note = MeGly
  SITE 14: note = C-terminal is: Carboxamide
  REGION 2..7: note = Cyclic bond: Abu to C
  DISULFID 2..7: note = Disulfid bond
RXNTWKCXXXXNXG

SEQ ID NO: 397 - protein, 14 aa, synthetic construct
  REGION 1..14: note = Modified peptide
  SITE 1: note = C-terminal is: Acetyl
  MOD_RES 1: note (1S,28S)-1-amino-7,16,25,30-tetraoxo-9,12,18,21-tetraoxa-6, 15,24,29-tetraazaoctatetracontane-1,28,48-tricarboxylic acid
  MOD_RES 2: note = L-penicillamine
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXG

SEQ ID NO: 398 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-5,14,23-trioxo-2-tetradecanamido-9,12,18, 21-tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXKNXG

SEQ ID NO: 399 - protein, 14 aa, synthetic construct
  REGION 1..14: note = Modified peptide
  SITE 1: note = C-terminal is: Acetyl
  MOD_RES 2: note = 7-methyl-L-tryptophan
  MOD_RES 3: note = N6-Acetyl-L-lysine
  MOD_RES 4: note = (S)-2-aminopentanoic acid 5-diyl
  MOD_RES 5: note = 4-(2-aminoethoxy)-L-phenylalanine
  MOD_RES 6: note = 2-naphthylalanine
  MOD_RES 7: note = 4-amino-4-carboxy-tetrahydropyran
  MOD_RES 8: note = (S)-2-aminopentanoic acid 5-diyl
  MOD_RES 10: note = 3-(2-pyridyl)-alanine
  MOD_RES 11: note = MeGly
  MOD_RES 12: note = K(PEG2PEG2gEC16OH)
  MOD_RES 14: note (S)-22-carboxy-1,10,19,24-tetraoxo-3,6,12,15-tetraoxa-9,18, 23-triazanonatriacontan-39-oic acid
  SITE 14: note = C-terminal is: Carboxamide
  REGION 4..8: note = Cyclic bond: (S)-2-aminopentanoic acid 5-diyl to (S)-2-aminopentanoic acid 5-diyl
  REGION 3..8: note = Cyclic bond: (S)-2-aminopentanoic acid 5-diyl to (S)-2-aminopentanoic acid 5-diyl
  DISULFID 3..8: note = Disulfid bond
  DISULFID 4..8: note = Disulfid bond
TWKXXXXXNXGXKX

SEQ ID NO: 400 - protein, 14 aa, synthetic construct
  REGION 1..14: note = Modified peptide
  SITE 1: note = C-terminal is: 5Ava
  MOD_RES 1: note = Abu
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is: Carboxamide
  REGION 1..6: note = Cyclic bond: Abu to C
  DISULFID 1..6: note = Disulfid bond
XNTWQCXXXENXGX

SEQ ID NO: 401 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-5,14,23-trioxo-2-tetradecanamido-9,12,18, 21-tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 402 - protein, 15 aa, synthetic construct
  REGION 1..15: note = Modified peptide
  SITE 1: note = C-terminal is: Acetyl
  SITE 1: note = D-Arginine
  MOD_RES 2: note = Abu
  MOD_RES 6: note = N6-Acetyl-L-lysine
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-2-dodecanamido-5,14,23-trioxo-9,12,18,21- tetraoxa-6,15,24-triazatriacontanedioic acid
  SITE 15: note = C-terminal is: Carboxamide
  REGION 2..7: note = Cyclic bond: Abu to C
  DISULFID 2..7: note = Disulfid bond
RXNTWKCXXXENXGX

SEQ ID NO: 403 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-2-dodecanamido-5,14,23-trioxo-9,12,18,21- tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 404 - protein, 14 aa, synthetic construct
  REGION 1..14: note = Modified peptide
  SITE 1: note = C-terminal is: Acetyl
  SITE 1: note = D-Arginine
  MOD_RES 2: note = Abu
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: Abu to C
  DISULFID 2..7: note = Disulfid bond
RXNTWXCXXXENXG

SEQ ID NO: 405 - protein, 13 aa, synthetic construct
  REGION 1..13: note = Modified peptide
  SITE 1: note = C-terminal is: Alpha-methyl L-lysine
  MOD_RES 1: note = Abu
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: Abu to C
  DISULFID 1..6: note = Disulfid bond
XXTWQCXXXENXG

SEQ ID NO: 406 - protein, 14 aa, synthetic construct
  REGION 1..14: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: Abu to C
  DISULFID 2..7: note = Disulfid bond
RXNTWXCXXXENXG

SEQ ID NO: 407 - protein, 14 aa, synthetic construct
  REGION 1..14: note = Modified peptide
  SITE 1: note = C-terminal is: Acetyl
  SITE 1: note = D-Arginine
  MOD_RES 2: note = Abu
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  SITE 14: note = C-terminal is: Carboxamide
  REGION 2..7: note = Cyclic bond: Abu to C
  DISULFID 2..7: note = Disulfid bond
RXNTWXCXXXENXG

SEQ ID NO: 408 - protein, 13 aa, synthetic construct
  REGION 1..13: note = Modified peptide
  SITE 1: note = C-terminal is: 3-(2-(2-aminoethoxy)ethoxy)propanal
  MOD_RES 1: note = L-penicillamine
  MOD_RES 2: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 409 - protein, 14 aa, synthetic construct
  REGION 1..14: note = Modified peptide
  SITE 1: note = C-terminal is: 3-(2-(2-aminoethoxy)ethoxy)propanal
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (1S,28S)-1-amino-7,16,25,30-tetraoxo-9,12,18,21-tetraoxa-6, 15,24,29-tetraazahexatetracontane-1,28,46-tricarboxylic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 410 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note (2S,29S)-29-amino-2-dodecanamido-5,14,23-trioxo-9,12,18,21- tetraoxa-6,15,24-triazatriacontanedioic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-2-dodecanamido-5,14,23-trioxo-9,12,18,21- tetraoxa-6,15,24-triazatriacontanedioic acid
  SITE 15: note = C-terminal is: Carboxamide
  REGION 2..7: note = Cyclic bond: L-penicillamine to L-penicillamine
  DISULFID 2..7: note = Disulfid bond
RXNTWXXXXXENXGX

SEQ ID NO: 411 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (S)-2-amino-8,17-dioxo-10,13-dioxa-7,16-diazatriacontanoic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 412 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (S)-2-amino-8,17,26-trioxo-10,13,19,22-tetraoxa-7,16,25-tri azanonatriacontanoic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 413 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (2S,29S)-29-amino-2-dodecanamido-5,14,23-trioxo-9,12,18,21- tetraoxa-6,15,24-triazatriacontanedioic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXKNXG

SEQ ID NO: 414 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-2-dodecanamido-5,14,23-trioxo-9,12,18,21- tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXKNXG

SEQ ID NO: 415 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-6,15-dimethyl-2-(N-methyl-17-(2H-tetrazol -5-yl)heptadecanamido)-5,14,23-trioxo-9,12,18,21-tetraoxa-6 ,15,24-triazatriacontanedioic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXENXGX

SEQ ID NO: 416 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note = K(PEG2PEG2-gEC16OH)
  SITE 15: note = C-terminal is:amido
  REGION 2..7: note = Cyclic bond: L-penicillamine to L-penicillamine
  DISULFID 2..7: note = Disulfid bond
RXNTWKXXXXENXGX

SEQ ID NO: 417 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note = MeGly
  MOD_RES 14: note 1-amino-23-carboxy-8,17,25-trioxo-3,6,12,15-tetraoxa-9,18,2 4-triazadotetracontan-42-oic acid
  SITE 14: note = C-terminal is: OH
  REGION 1..6: note = Cyclic bond: L-penicillamine to L-penicillamine
  DISULFID 1..6: note = Disulfid bond
XNTWKXXXXKNXGX

SEQ ID NO: 418 - protein, 15 aa, synthetic construct
  REGION 1..15: note = Modified peptide
  SITE 1: note = C-terminal is: Acetyl
  SITE 1: note = D-Arginine
  MOD_RES 2: note = Abu
  MOD_RES 5: note = 7-methyl-L-tryptophan
  MOD_RES 6: note = N6-Acetyl-L-lysine
  MOD_RES 7: note = alpha-methylcysteine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-2-dodecanamido-5,14,23-trioxo-9,12,18,21- tetraoxa-6,15,24-triazatriacontanedioic acid
  SITE 15: note = C-terminal is: Carboxamide
  REGION 2..7: note = Cyclic bond: Abu to C
  DISULFID 2..7: note = Disulfid bond
RXNTWKCXXXENXGX

SEQ ID NO: 419 - protein, 15 aa, synthetic construct
  REGION 1..15: note = Modified peptide
  SITE 1: note = C-terminal is: (S)-22-dodecanamido-1,10,19-trioxo-3,6,12,15-tetraoxa-9,18- diazatricosan-23-oic acid
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-2-dodecanamido-5,14,23-trioxo-9,12,18,21- tetraoxa-6,15,24-triazatriacontanedioic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXENXGX

SEQ ID NO: 420 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-methoxyphenylalanine
  MOD_RES 8: note = 2-naphthylalanine
  MOD_RES 9: note = 4-amino-4-carboxy-tetrahydropyran
  MOD_RES 10: note = N6-Acetyl-L-lysine
  MOD_RES 12: note = 3-(2-pyridyl)-alanine
  MOD_RES 13: note (R)-2-amino-8,48-dioxo-11,14,17,20,23,26,29,32,35,38,41,44- dodecaoxa-7,47-diazapentahexacontanedioic acid
  SITE 13: note = C-terminal is:amido
  REGION 1..6: note = Cyclic bond: L-penicillamine to L-penicillamine
  DISULFID 1..6: note = Disulfid bond
XLTWKXXXXKLXX

SEQ ID NO: 421 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (2S,29S)-29-amino-2-dodecanamido-5,14,23-trioxo-9,12,18,21- tetraoxa-6,15,24-triazatriacontanedioic acid
  SITE 15: note = C-terminal is: Carboxamide
  REGION 2..7: note = Disulfid - Cyclic bond: L-penicillamine to L-penicillamine
RXNTWKXXXXENXGX

SEQ ID NO: 422 - protein, 14 aa, synthetic construct
  REGION 1..14: note = Modified peptide
  SITE 1: note = C-terminal is: Acetyl
  MOD_RES 1: note d(1S,28S)-1-amino-7,16,25,30-tetraoxo-9,12,18,21-tetraoxa-6 ,15,24,29-tetraazahexatetracontane-1,28,46-tricarboxylic acid
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = (S)-4,4-difluoropyrrolidine-2-carboxylic acid
  SITE 14: note = C-terminal is: Carboxamide
  REGION 2..7: note = Cyclic bond: L-penicillamine to L-penicillamine
  DISULFID 2..7: note = Disulfid bond
XXNTWKXXXXKNXX

SEQ ID NO: 423 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note = N6-Acetyl-L-lysine
  MOD_RES 13: note = 3-(2-pyridyl)-alanine
  MOD_RES 14: note = MeGly
  MOD_RES 15: note 1-amino-21-carboxy-8,17,23-trioxo-3,6,12,15-tetraoxa-9,18,2 2-
  SITE 15: note = C-terminal is: OH
  REGION 2..7: note = Cyclic bond: L-penicillamine to L-penicillamine
  DISULFID 2..7: note = Disulfid bond
RXNTWKXXXXKNXGX

SEQ ID NO: 424 - protein, 15 aa, synthetic construct
  REGION 1..15: note = Modified peptide
  SITE 1: note = C-terminal is: Acetyl
  MOD_RES 1: note = dKSP6
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  REGION 2..7: note = Cyclic bond: L-penicillamine to L-penicillamine
  DISULFID 2..7: note = Disulfid bond
XXNTWKXXXXENXGX

SEQ ID NO: 425 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (2S,29S)-29-amino-2-dodecanamido-5,14,23-trioxo-9,12,18,21- tetraoxa-6,15,24-triazatriacontanedioic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XXTWKXXXXENXG

SEQ ID NO: 426 - protein, 13 aa, synthetic construct
  REGION 1..13: note = Modified peptide
  SITE 1: note = C-terminal is: Acetyl
  MOD_RES 1: note = L-penicillamine
  MOD_RES 2: note = N6-tetradecanoyl-L-lysine
  MOD_RES 4: note = 7-methyl-L-tryptophan
  MOD_RES 5: note = N6-Acetyl-L-lysine
  SITE 6: note = C-terminal is: Carboxamide
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XKTWKXXXXENXG

SEQ ID NO: 427 - protein, 13 aa, synthetic construct
  REGION 1..13: note = Modified peptide
  SITE 1: note = C-terminal is: (S)-1,10,19-trioxo-22-tetradecanamido-3,6,12,15-tetraoxa-9, 18-diazatricosan-23-oic acid
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-5,14,23-trioxo-2-tetradecanamido-9,12,18, 21-tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 428 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-tetradecanoyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXENXG

SEQ ID NO: 429 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 11: note (S)-23-amino-1-((3',6'-dihydroxy-3-oxo-3H-spiro[isobenzofur an-1,9'-xanthen]-5-yl)amino)-17-oxo-1-thioxo-5,8,11,14-tetr aoxa-2,18-diazatetracosan-24-oic acid
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazahexatetracontane-1,28,46-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXXNXGX

SEQ ID NO: 430 - protein, 14 aa, synthetic construct
  REGION 1..14: note = Modified peptide
  SITE 1: note = C-terminal is: Acetyl
  MOD_RES 2: note = 7-methyl-L-tryptophan
  MOD_RES 3: note = N6-Acetyl-L-lysine
  MOD_RES 4: note = (S)-2-aminopentanoic acid 5-diyl
  MOD_RES 5: note = 4-(2-aminoethoxy)-L-phenylalanine
  MOD_RES 6: note = 2-naphthylalanine
  MOD_RES 7: note = 4-amino-4-carboxy-tetrahydropyran
  MOD_RES 8: note = (S)-2-aminopentanoic acid 5-diyl
  MOD_RES 10: note = 3-(2-pyridyl)-alanine
  MOD_RES 11: note = MeGly
  MOD_RES 12: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 14: note (S)-22-carboxy-1,10,19,24-tetraoxo-3,6,12,15-tetraoxa-9,18, 23-triazahentetracontan-41-oic acid
  SITE 14: note = C-terminal is: Carboxamide
  REGION 4..8: note = Cyclic bond: (S)-2-aminopentanoic acid 5-diyl to (S)-2-aminopentanoic acid 5-diyl
  REGION 3..8: note = Cyclic bond: (S)-2-aminopentanoic acid 5-diyl to (S)-2-aminopentanoic acid 5-diyl
  DISULFID 3..8: note = Disulfid bond
  DISULFID 4..8: note = Disulfid bond
TWKXXXXXNXGXKX

SEQ ID NO: 431 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note (2S,29S)-29-amino-5,14,23-trioxo-2-tetradecanamido-9,12,18, 21-tetraoxa-6,15,24-triazatriacontanedioic acid
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 432 - protein, 14 aa, synthetic construct
  REGION 1..14: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note (3S,30S)-9,18,27,32-tetraoxo-11,14,20,23-tetraoxa-2,8,17,26 ,31-pentaazaoctatetracontane-3,30,48-tricarboxylic acid
  SITE 14: note = C-terminal is: Carboxamide
  REGION 2..7: note = Cyclic bond: L-penicillamine to L-penicillamine
  DISULFID 2..7: note = Disulfid bond
RXNTWKXXXXENXX

SEQ ID NO: 433 - protein, 13 aa, synthetic construct
  REGION 1..13: note = Modified peptide
  SITE 1: note = C-terminal is: Acetyl
  MOD_RES 1: note = L-penicillamine
  MOD_RES 2: note (1S,28S)-1-amino-7,16,25,30-tetraoxo-9,12,18,21-tetraoxa-6, 15,24,29-tetraazadotetracontane-1,28,42-tricarboxylic acid
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Disulfid - Cyclic bond: L-penicillamine to L-penicillamine
XXTWKXXXXENXG

SEQ ID NO: 434 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note (1S,28S)-1-amino-7,16,25,30-tetraoxo-9,12,18,21-tetraoxa-6, 15,24,29-tetraazadotetracontane-1,28,42-tricarboxylic acid
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWXXXXXENXG

SEQ ID NO: 435 - protein, 13 aa, synthetic construct
  REGION 1..13: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 10: note = N6-tetradecanoyl-L-lysine
  MOD_RES 12: note = 3-(2-pyridyl)-alanine
  MOD_RES 13: note = MeGly
  SITE 13: note = C-terminal is: Carboxamide
  REGION 1..6: note = Cyclic bond: L-penicillamine to L-penicillamine
  DISULFID 1..6: note = Disulfid bond
XNTWKXXXXXNXG

SEQ ID NO: 436 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-5,14,23-trioxo-2-((R)-2-tetradecanoylpyrr olidin-1-yl)-9,12,18,21-tetraoxa-6,15,24-triazatriacontaned ioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 437 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  SITE 11: note = D-Lysine
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazaoctatetracontane-1,28,48-tricarboxylic acid
  SITE 15: note = C-terminal is: Carboxamide
  REGION 2..7: note = Cyclic bond: L-penicillamine to L-penicillamine
  DISULFID 2..7: note = Disulfid  bond
RXNTWKXXXXKNXGX

SEQ ID NO: 438 - protein, 15 aa, synthetic construct
  REGION 1..15: note = Modified peptide
  SITE 1: note = C-terminal is: Acetyl
  SITE 1: note = D-Arginine
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  MOD_RES 15: note (1S,28S)-1-amino-7,16,25,30-tetraoxo-9,12,18,21-tetraoxa-6, 15,24,29-tetraazaoctatetracontane-1,28,48-tricarboxylic acid
  SITE 15: note = C-terminal is: Carboxamide
  REGION 2..7: note = Cyclic bond: L-penicillamine to L-penicillamine
  DISULFID 2..7: note = Disulfid bond
RXNTWKXXXXENXGX

SEQ ID NO: 439 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-5,14,23-trioxo-2-((S)-2-tetradecanoylpyrr olidin-1-yl)-9,12,18,21-tetraoxa-6,15,24-triazatriacontaned ioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 440 - protein, 14 aa, synthetic construct
  REGION 1..14: note = Modified peptide
  SITE 1: note = C-terminal is: Acetyl
  MOD_RES 1: note = L-penicillamine
  MOD_RES 4: note = 7-methyl-L-tryptophan
  MOD_RES 5: note = N6-Acetyl-L-lysine
  MOD_RES 6: note = L-penicillamine
  MOD_RES 7: note = 4-(2-aminoethoxy)-L-phenylalanine
  MOD_RES 8: note = 2-naphthylalanine
  MOD_RES 9: note = 4-amino-4-carboxy-tetrahydropyran
  MOD_RES 12: note = 3-(2-pyridyl)-alanine
  MOD_RES 13: note = MeGly
  MOD_RES 14: note (2S,29S)-29-amino-2-(2-(N-methyltetradecanamido)acetamido)- 5,14,23-trioxo-9,12,18,21-tetraoxa-6,15,24-triazatriacontan edioic acid
  SITE 14: note = C-terminal is: Carboxamide
  REGION 1..6: note = Cyclic bond: L-penicillamine to L-penicillamine
  DISULFID 1..6: note = Disulfid bond
XNTWKXXXXENXGX

SEQ ID NO: 441 - protein, 14 aa, synthetic construct
  REGION 1..14: note = Modified peptide
  SITE 1: note = C-terminal is: Acetyl
  MOD_RES 1: note = (R)-6-amino-6-carboxy-N,N,N-trimethylhexan-1-aminium
  MOD_RES 2: note = L-penicillamine
  MOD_RES 5: note = 7-methyl-L-tryptophan
  MOD_RES 6: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
KXNTWXXXXXENXG

SEQ ID NO: 442 - protein, 14 aa, synthetic construct
  REGION 1..14: note = Modified peptide
  SITE 1: note = C-terminal is: (S)-22-carboxy-1,10,19,24-tetraoxo-3,6,12,15-tetraoxa-9,18, 23-triazahentetracontan-41-oic acid
  MOD_RES 1: note = (R)-6-amino-6-carboxy-N,N,N-trimethylhexan-1-aminium
  MOD_RES 2: note = L-penicillamine
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
KXNTWKXXXXENXG

SEQ ID NO: 443 - protein, 14 aa, synthetic construct
  REGION 1..14: note = Modified peptide
  SITE 1: note = C-terminal is: Acetyl
  MOD_RES 1: note = (R)-6-amino-6-carboxy-N,N,N-trimethylhexan-1-aminium
  MOD_RES 2: note = L-penicillamine
  MOD_RES 3: note (1S,28S)-1-amino-7,16,25,30-tetraoxo-9,12,18,21-tetraoxa-6, 15,24,29-tetraazahexatetracontane-1,28,46-tricarboxylic acid
  MOD_RES 5: note = 7-methyl-L-tryptophan
  MOD_RES 6: note = N6-Acetyl-L-lysine
  MOD_RES 7: note = L-penicillamine
  MOD_RES 8: note = 4-(2-aminoethoxy)-L-phenylalanine
  MOD_RES 9: note = 2-naphthylalanine
  MOD_RES 10: note = 4-amino-4-carboxy-tetrahydropyran
  MOD_RES 13: note = 3-(2-pyridyl)-alanine
  MOD_RES 14: note = MeGly
  REGION 2..7: note = Cyclic bond: L-penicillamine to L-penicillamine
  DISULFID 2..7: note = Disulfid bond
KXXTWKXXXXENXG

What is claimed is:

1. An interleukin-23 receptor inhibitor selected from the group consisting of:

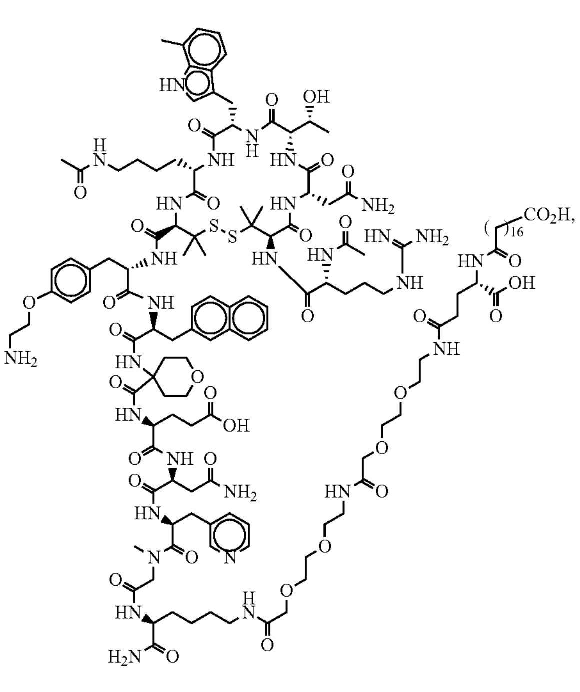

-continued

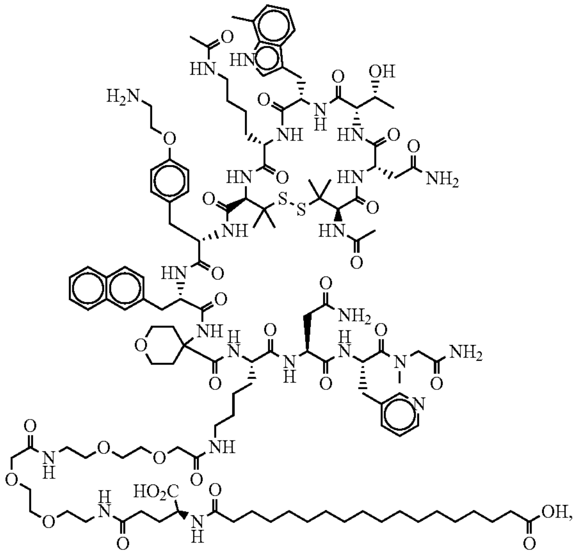

-continued
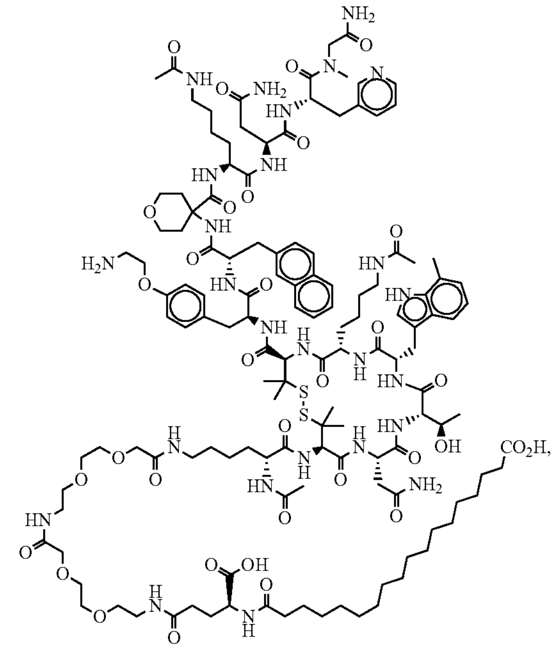
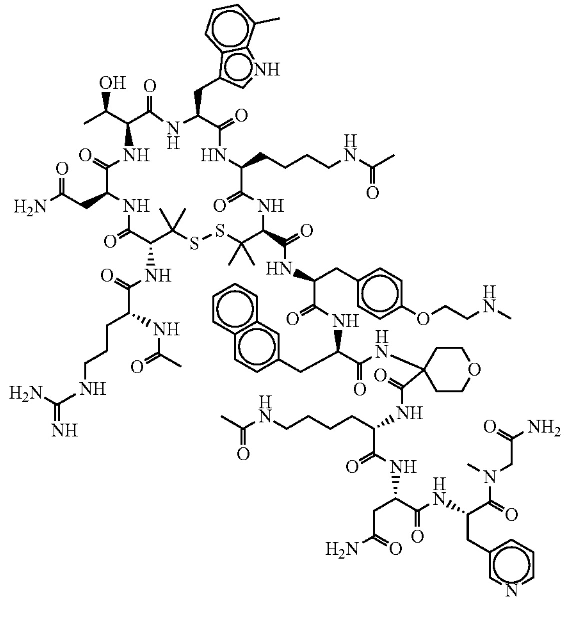
-continued
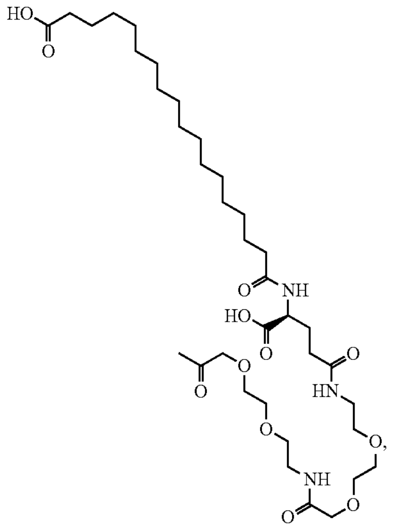
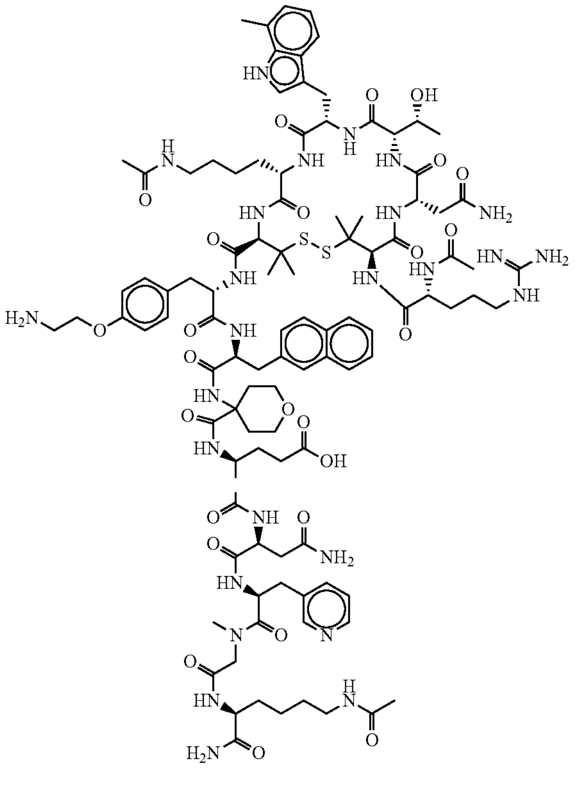

-continued
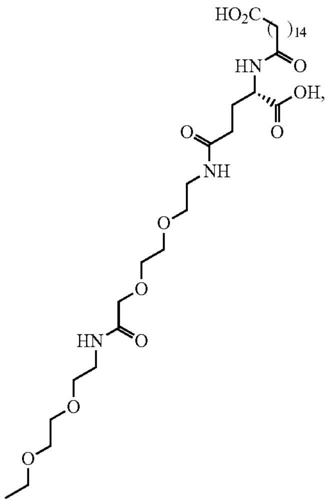
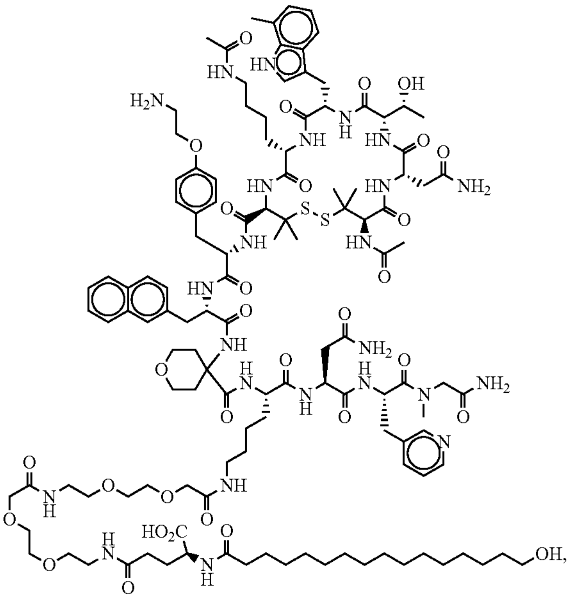
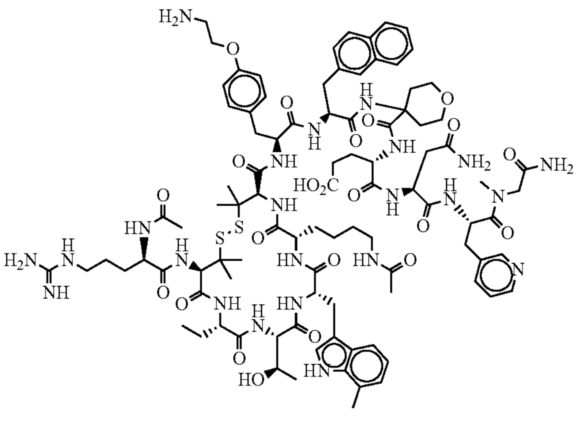
-continued
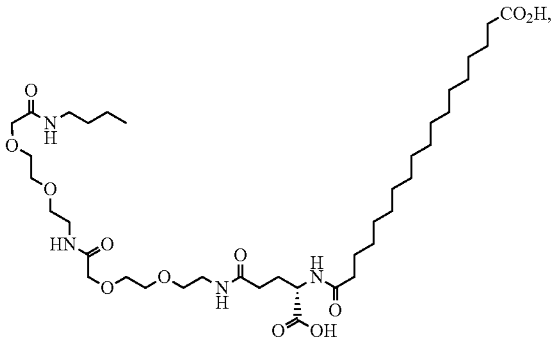
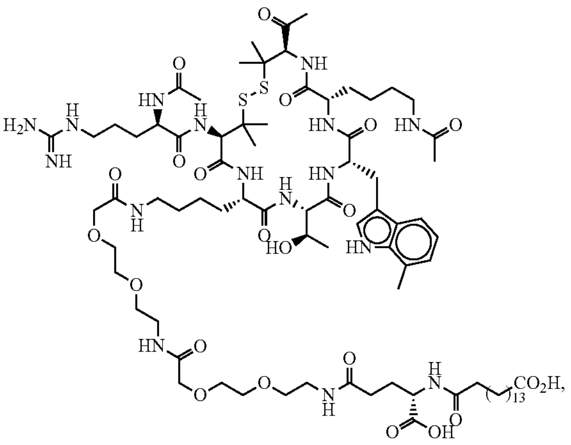
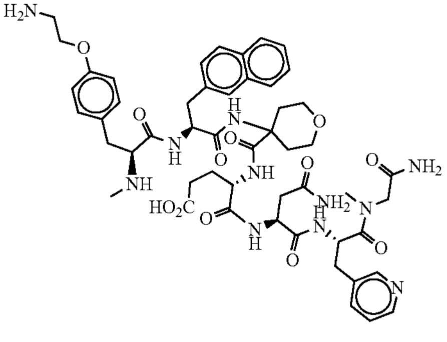

-continued
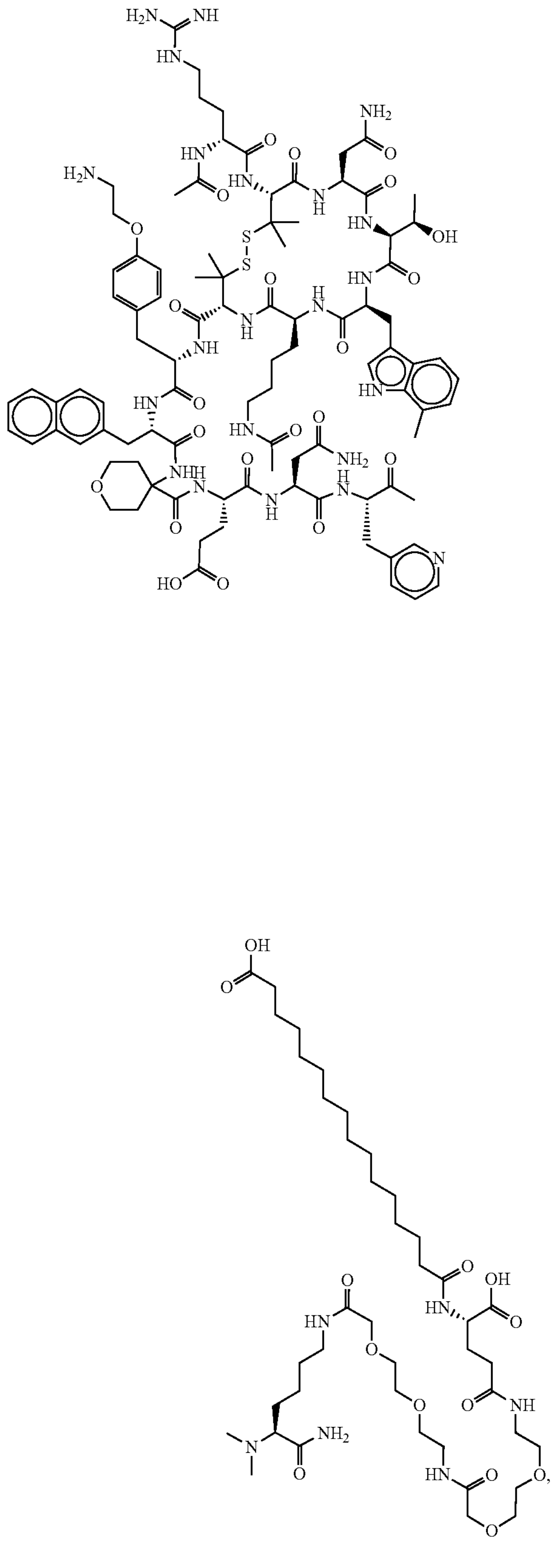
-continued
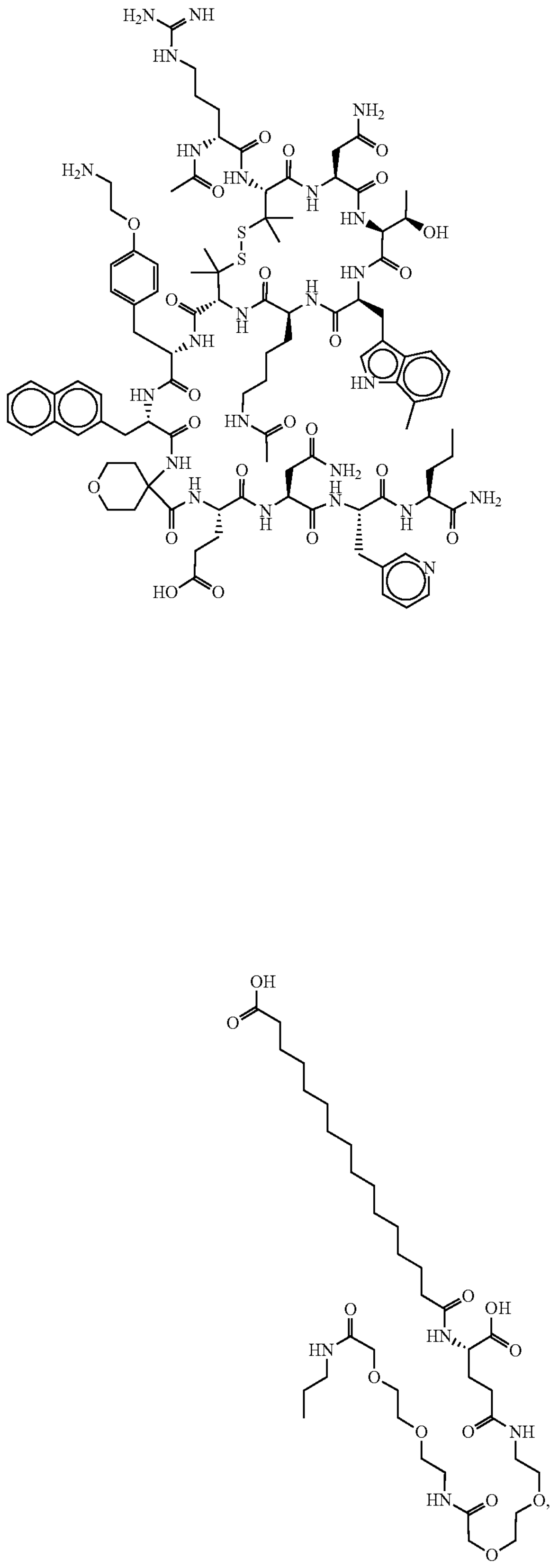

-continued
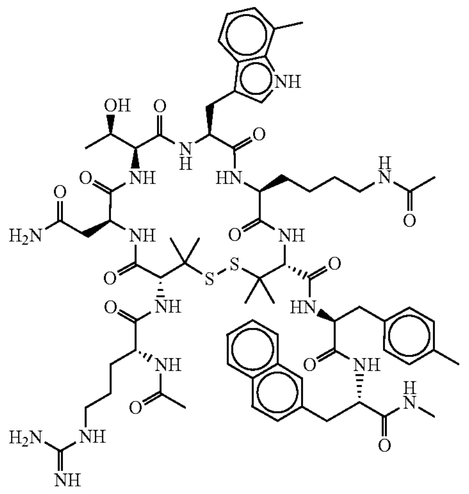
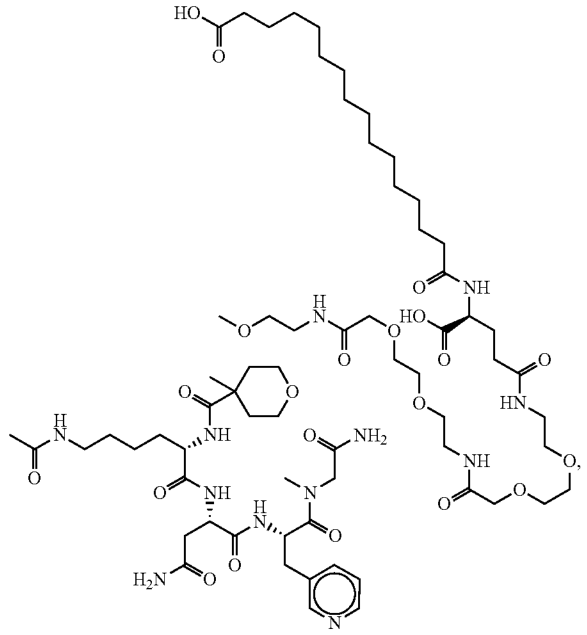
-continued
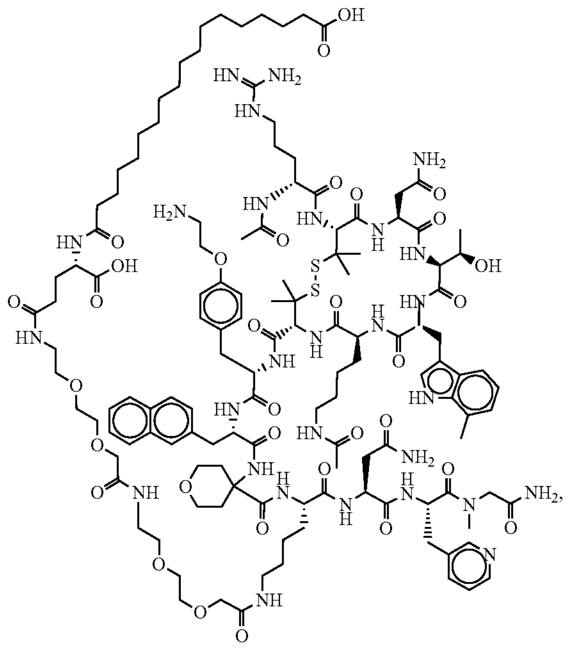
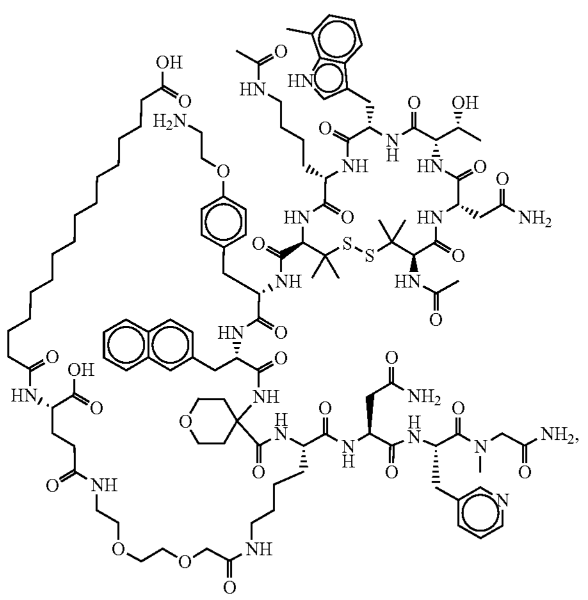

-continued
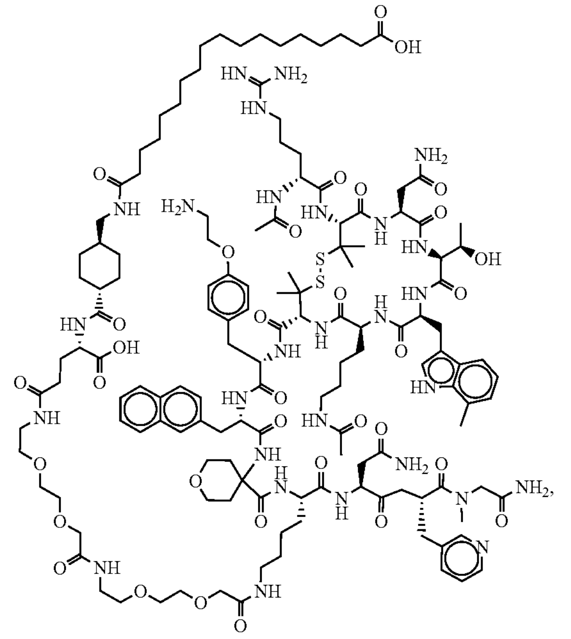
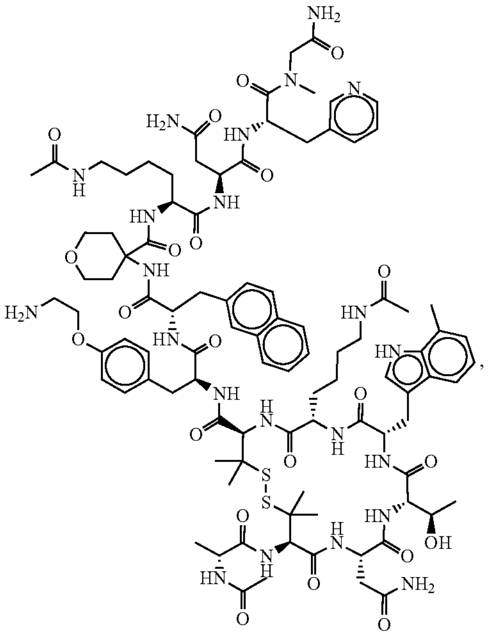
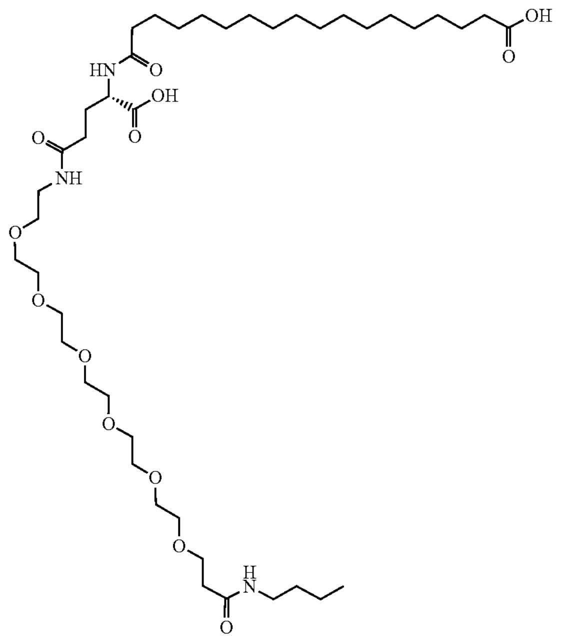
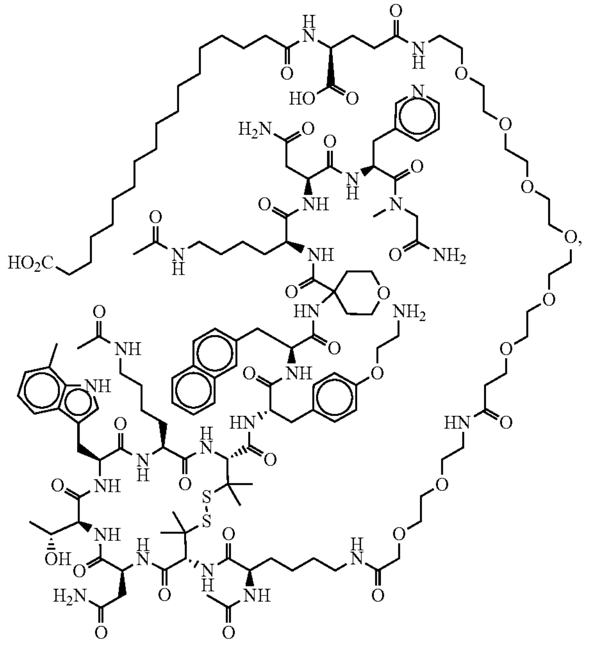

-continued
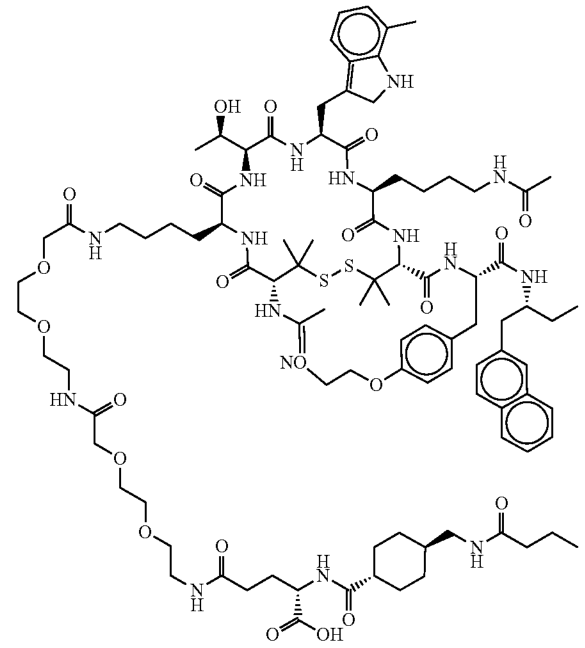
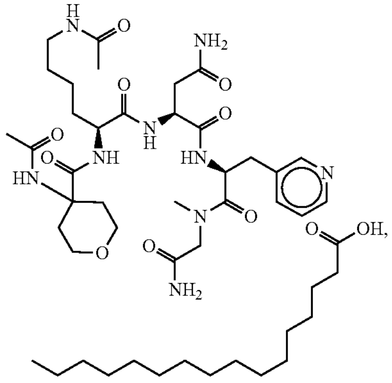
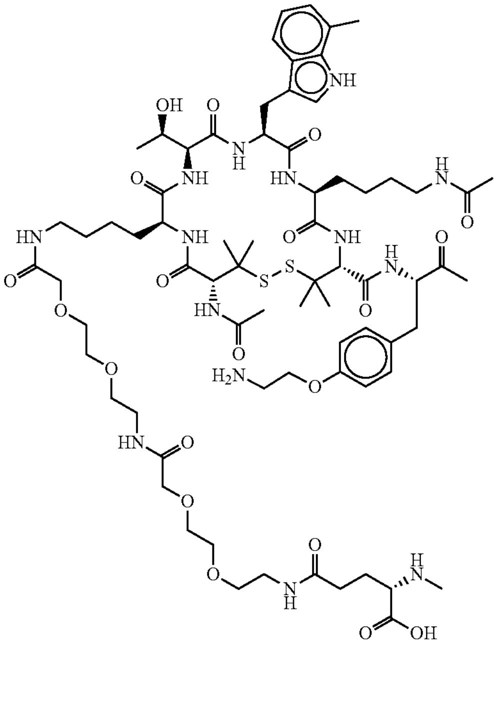
-continued
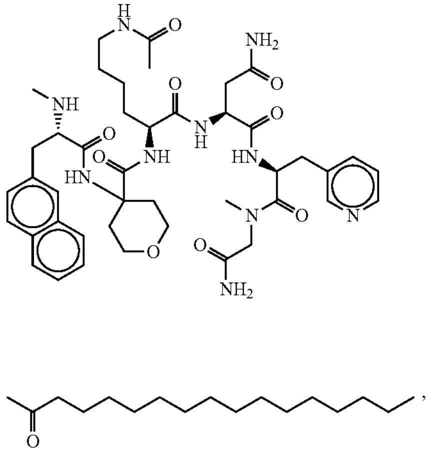
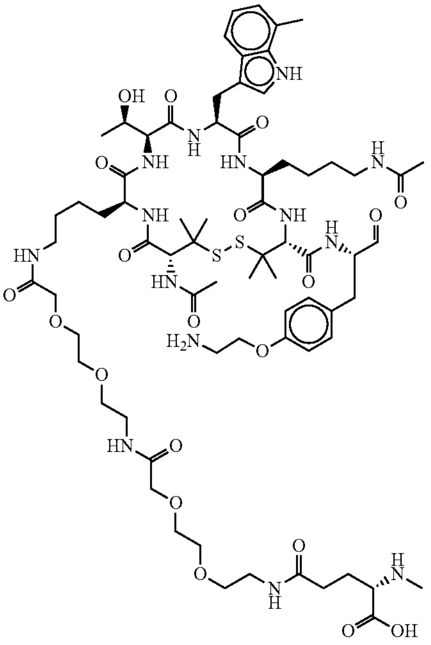
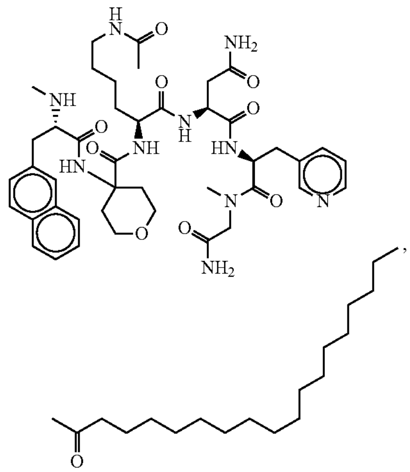

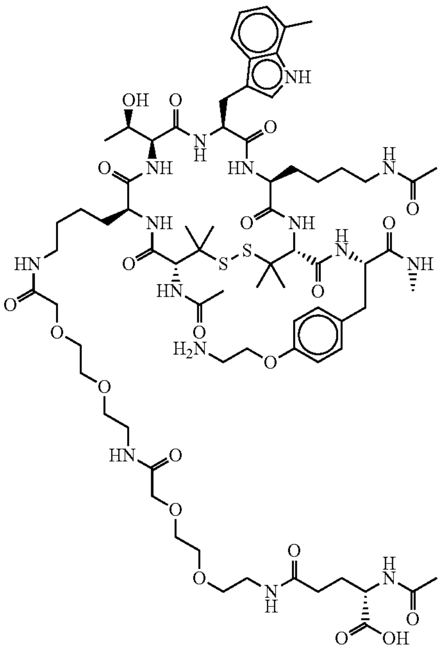
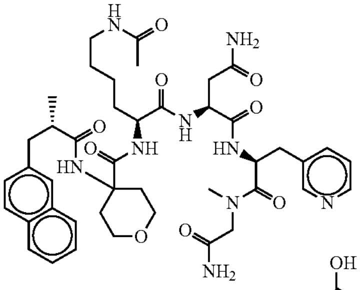
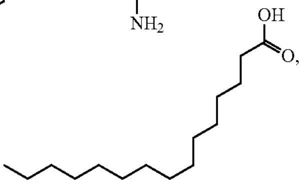
, and
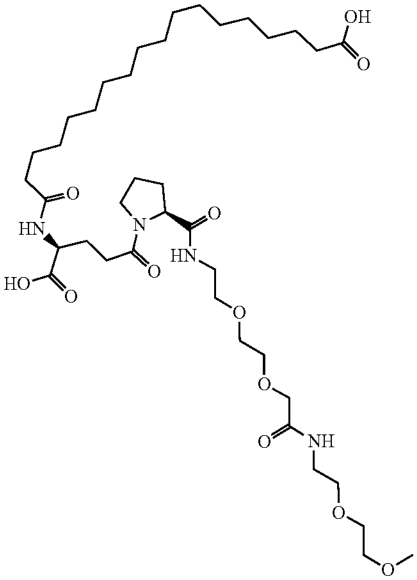
-continued
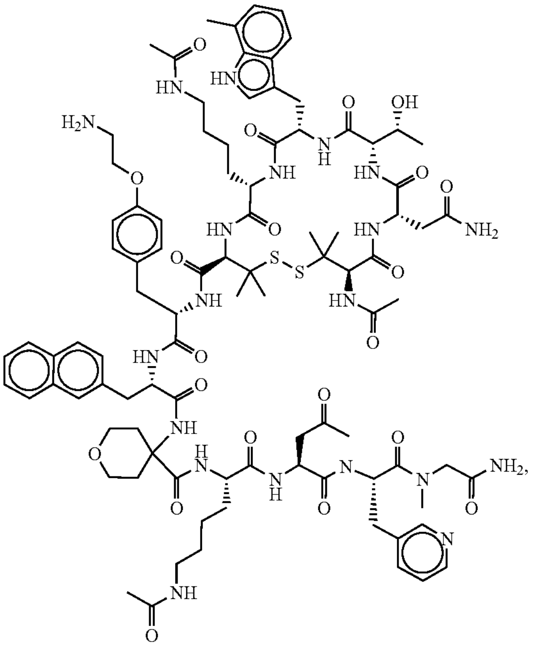
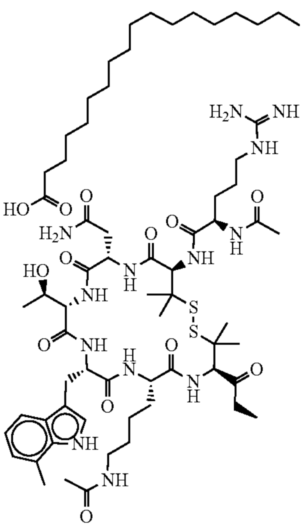

-continued
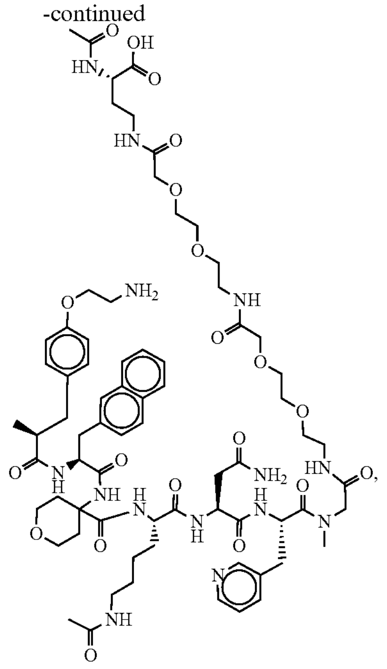
or a pharmaceutically acceptable salt thereof.
2. The interleukin-23 receptor inhibitor of claim 1, having the following structure:
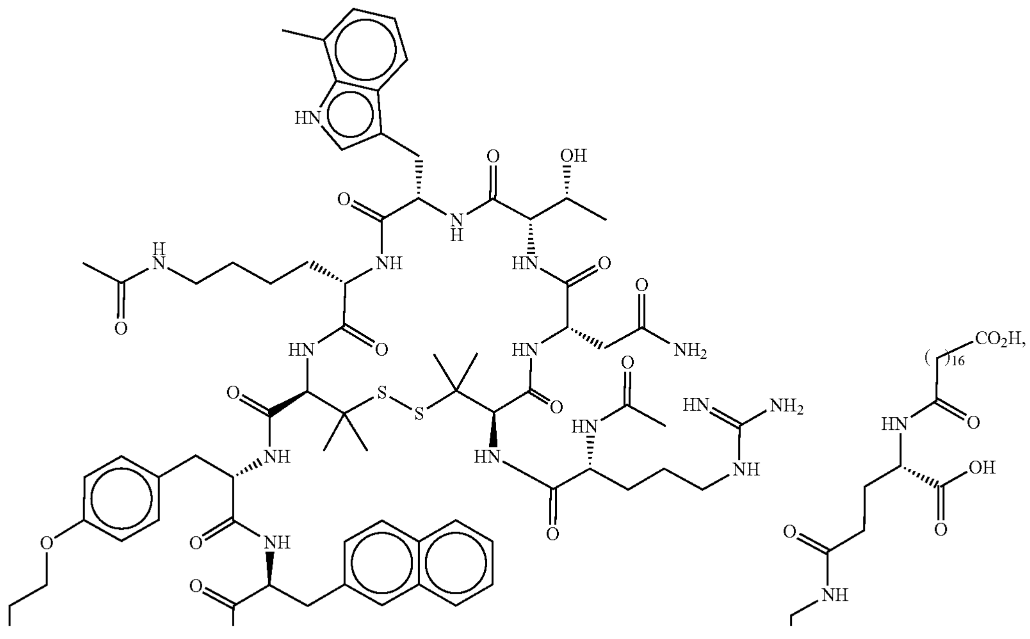

-continued
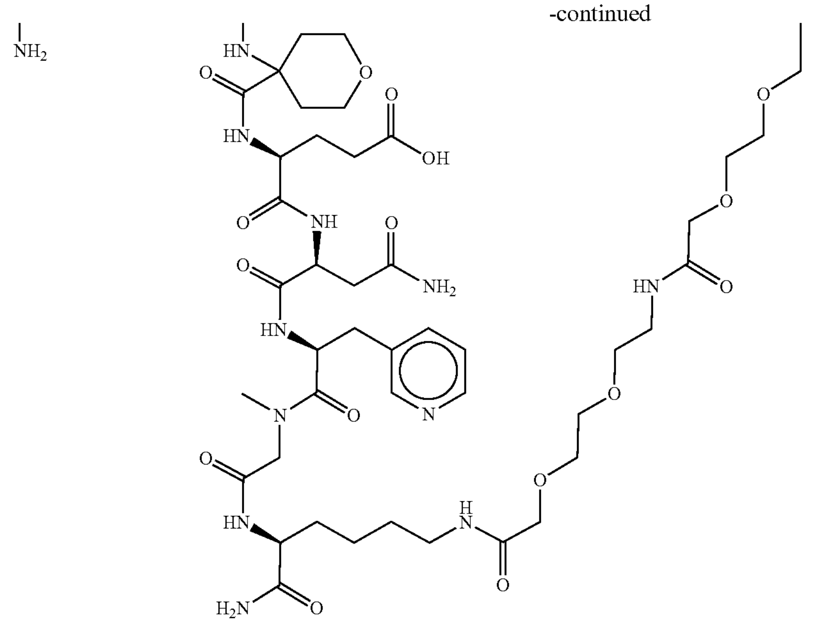
or a pharmaceutically acceptable salt thereof.
3. The interleukin-23 receptor inhibitor of claim 1, having the following structure:
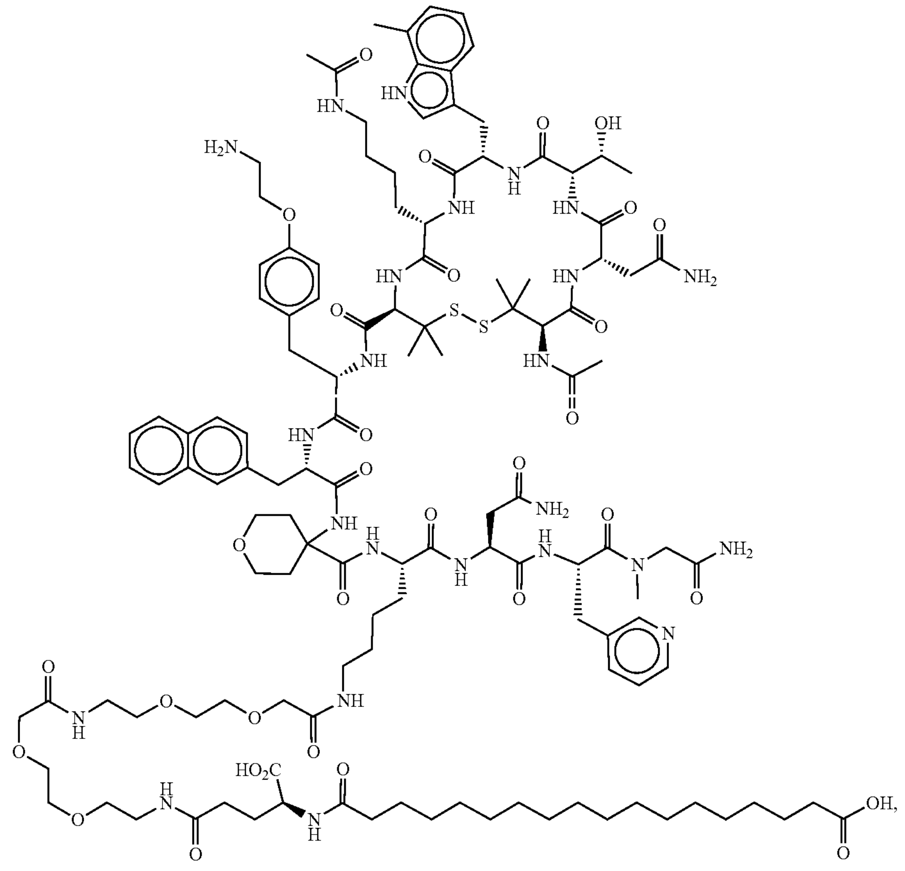
or a pharmaceutically acceptable salt thereof.

4. The interleukin-23 receptor inhibitor of claim 1, having the following structure:
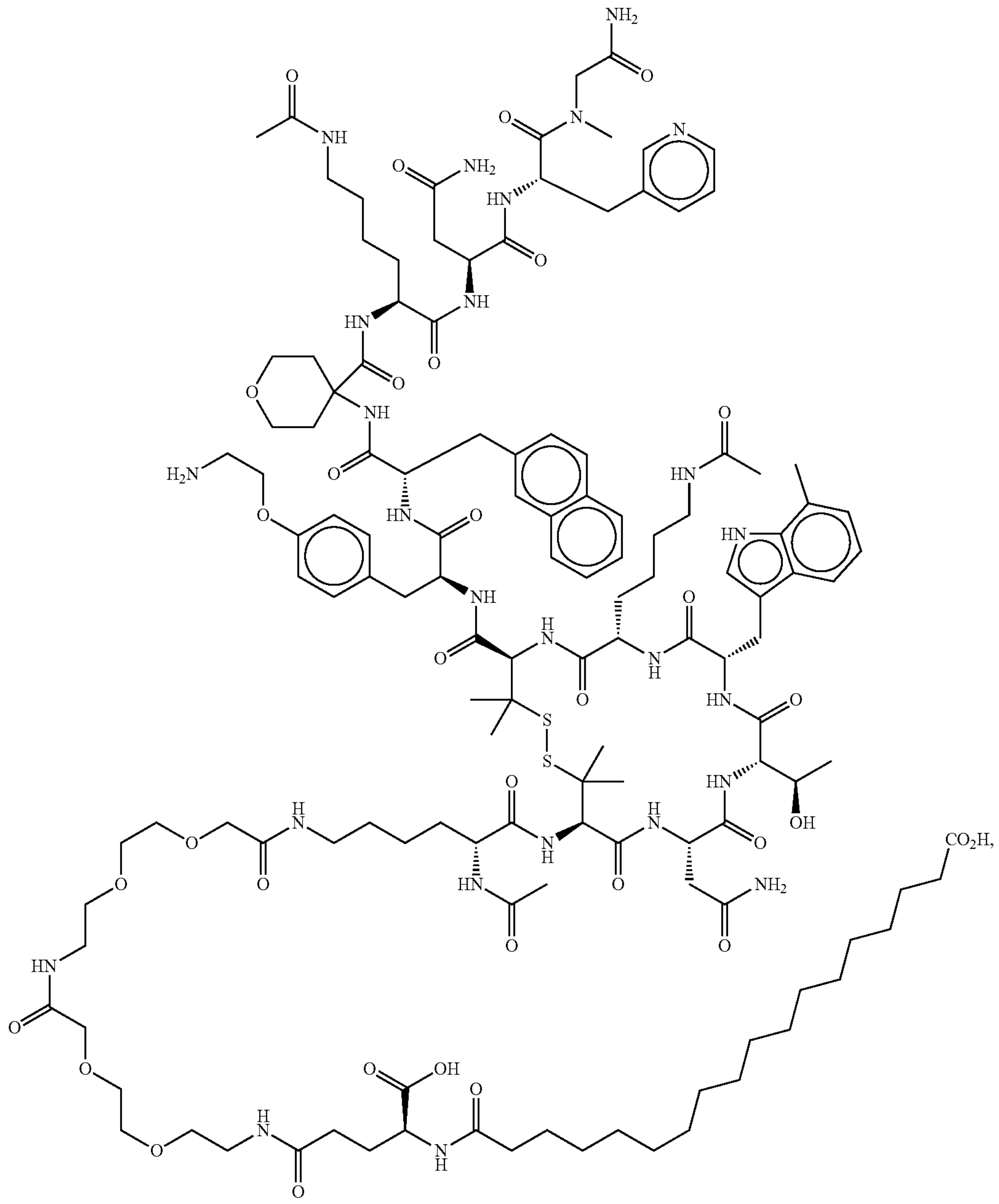
or a pharmaceutically acceptable salt thereof.

5. The interleukin-23 receptor inhibitor of claim 1, having the following structure:
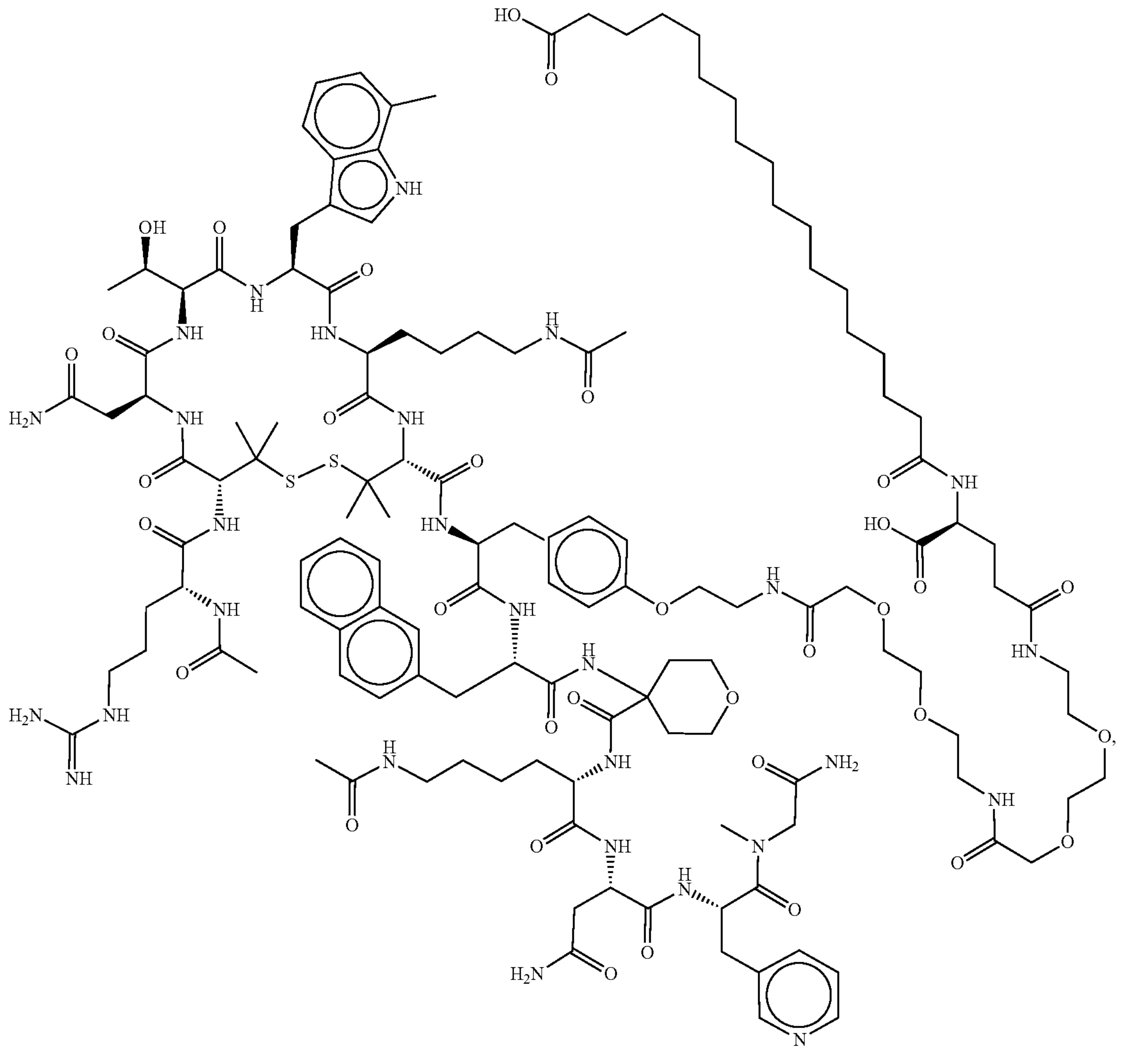
or a pharmaceutically acceptable salt thereof.

6. The interleukin-23 receptor inhibitor of claim 1, having the following structure:
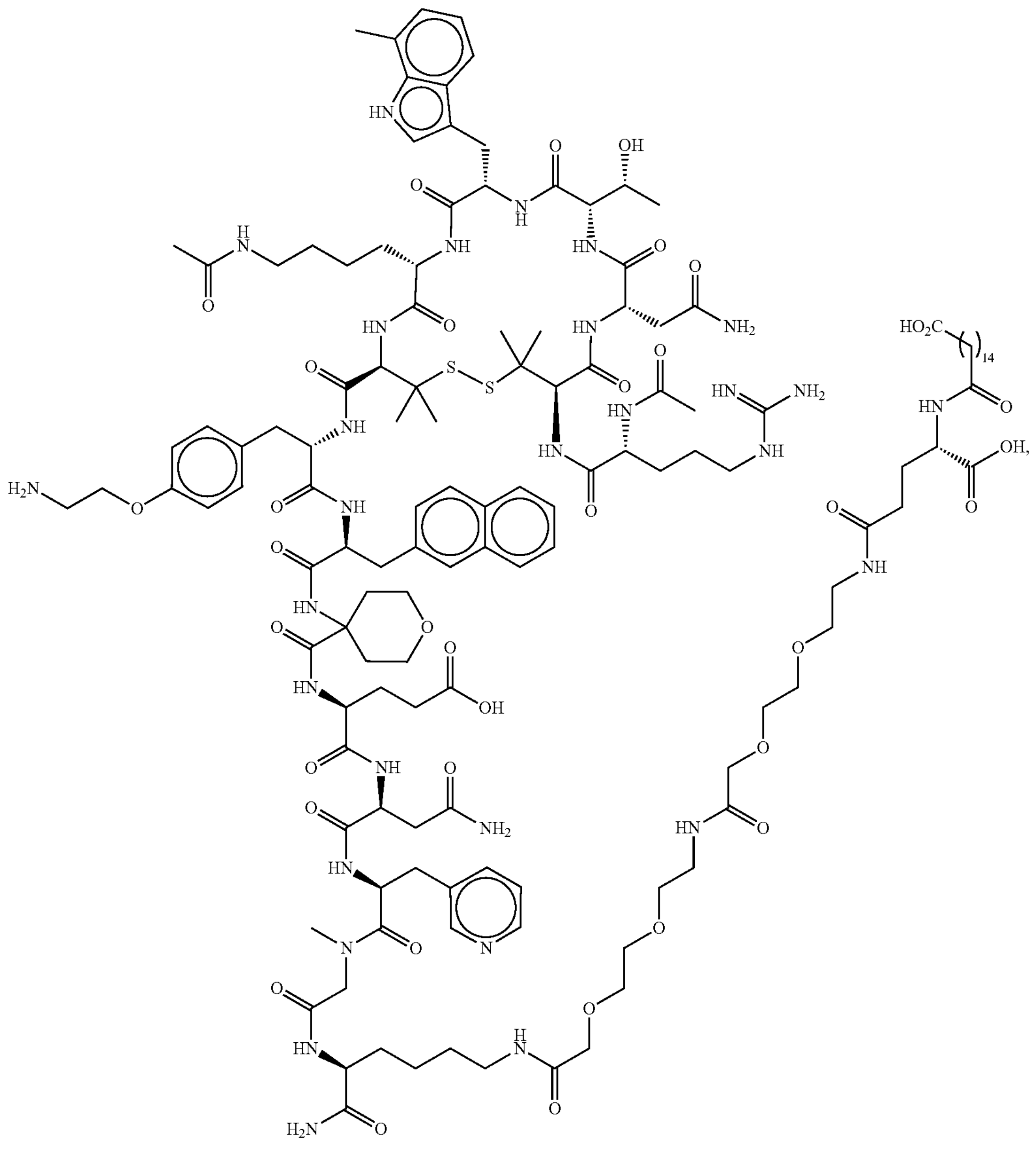
or a pharmaceutically acceptable salt thereof.

7. The interleukin-23 receptor inhibitor of claim 1, having the following structure:
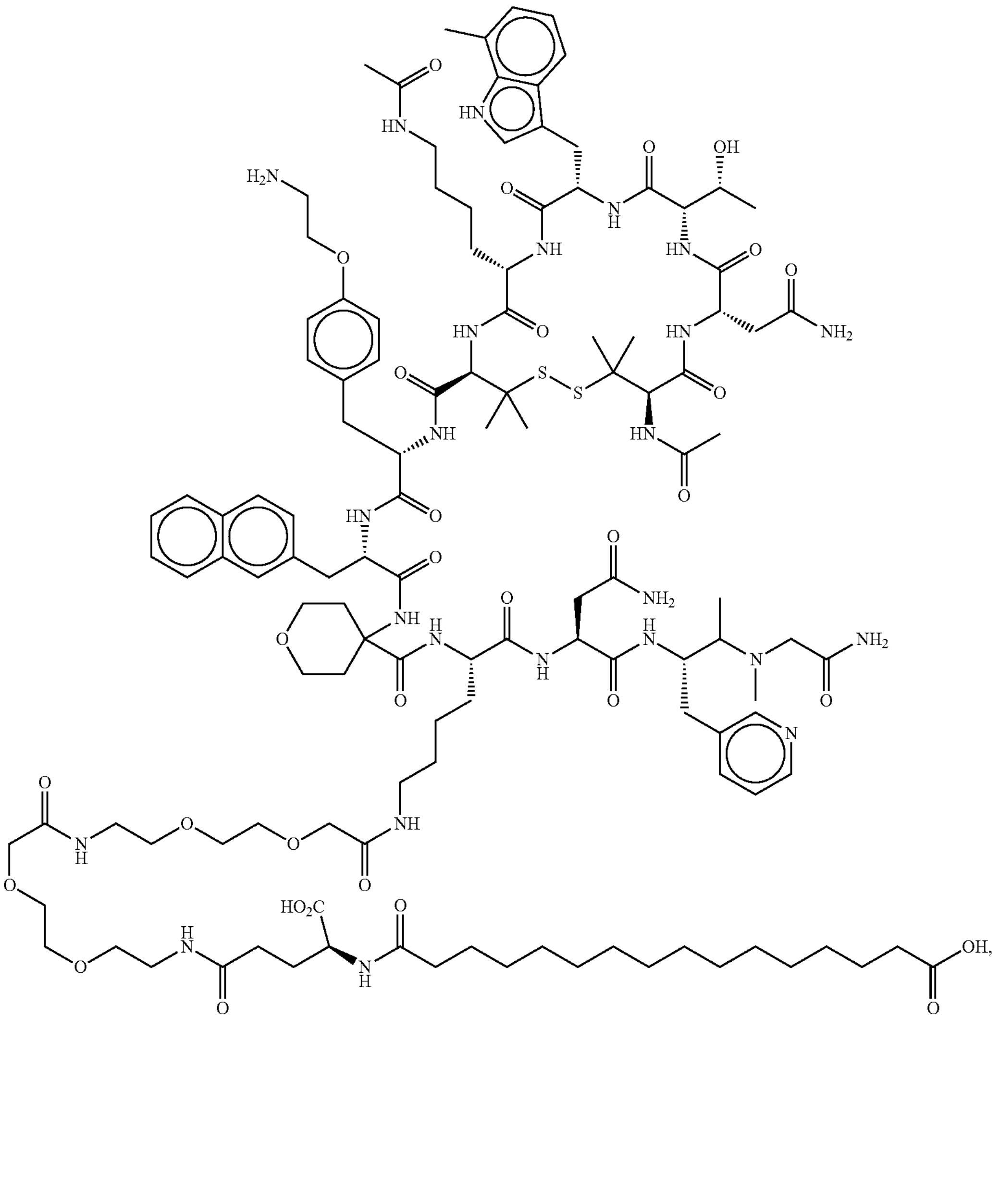
or a pharmaceutically acceptable salt thereof.

8. The interleukin-23 receptor inhibitor of claim 1, having the following structure:
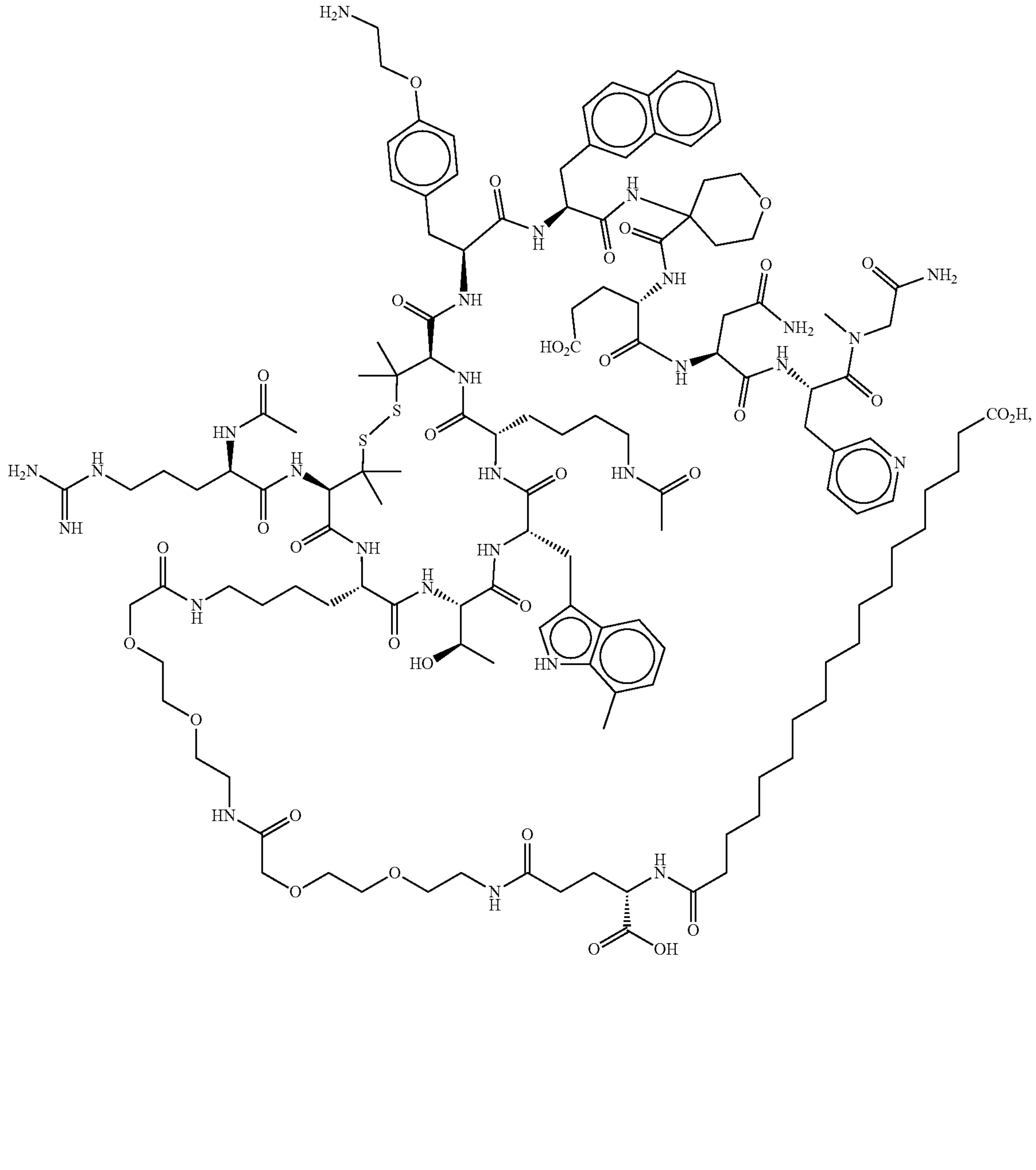
or a pharmaceutically acceptable salt thereof.

9. The interleukin-23 receptor inhibitor of claim 1, having the following structure:
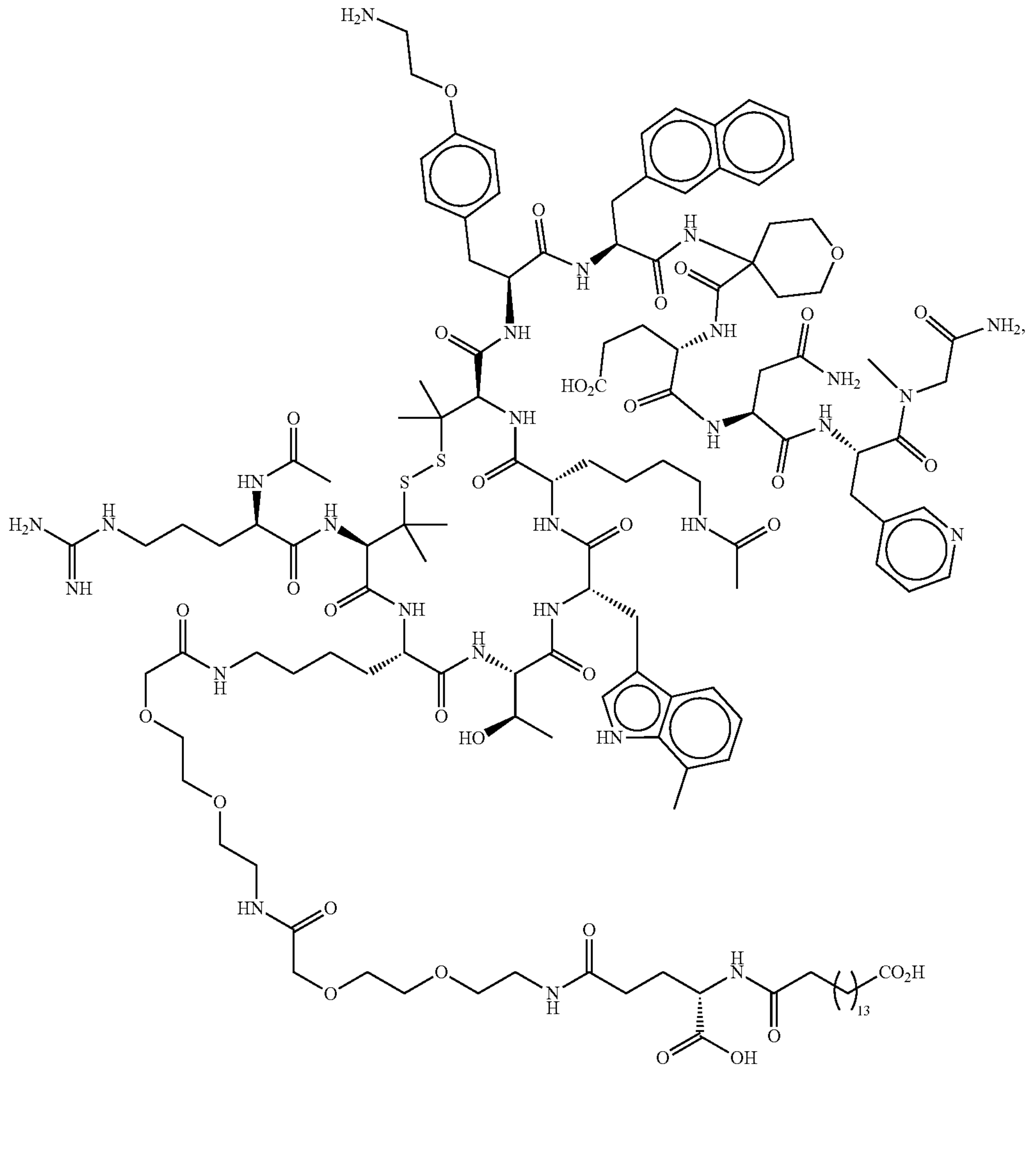
or a pharmaceutically acceptable salt thereof.

10. The interleukin-23 receptor inhibitor of claim 1, having the following structure:
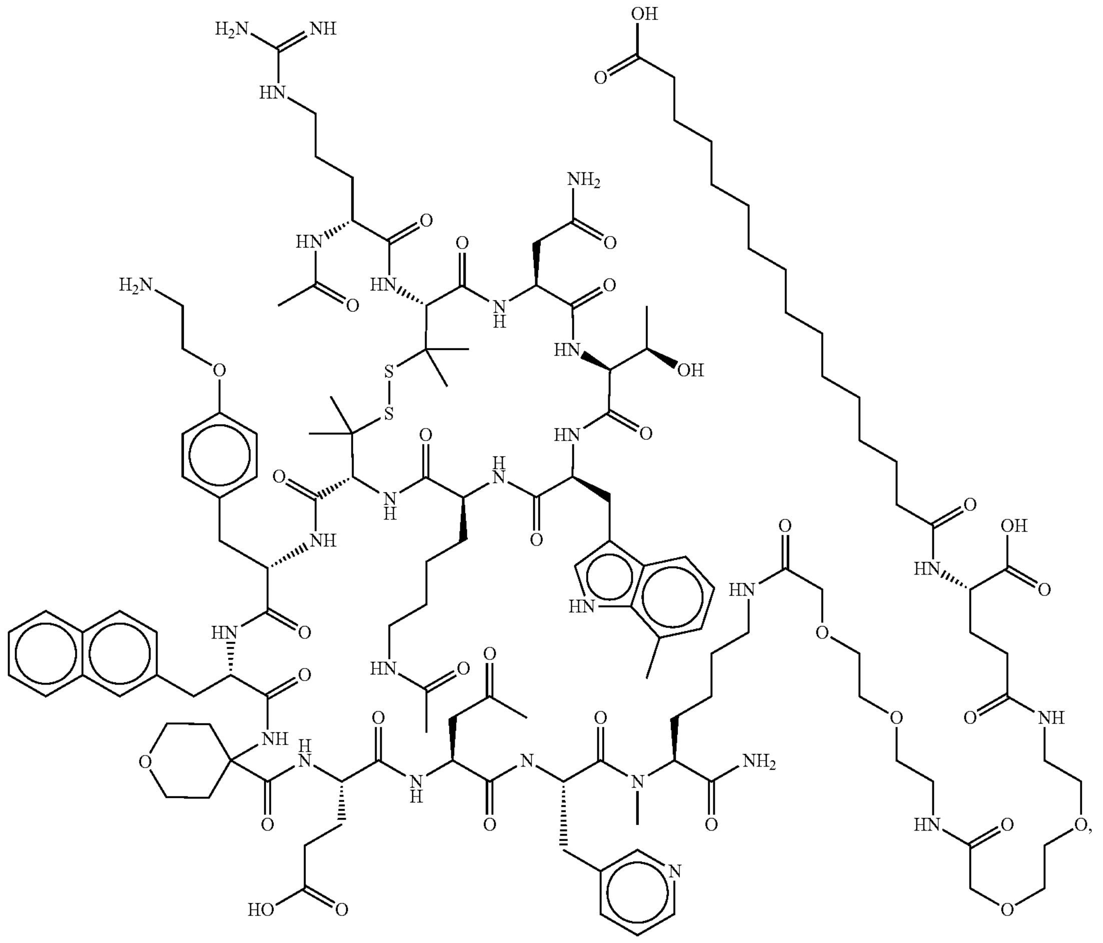
or a pharmaceutically acceptable salt thereof.

11. The interleukin-23 receptor inhibitor of claim 1, having the following structure:
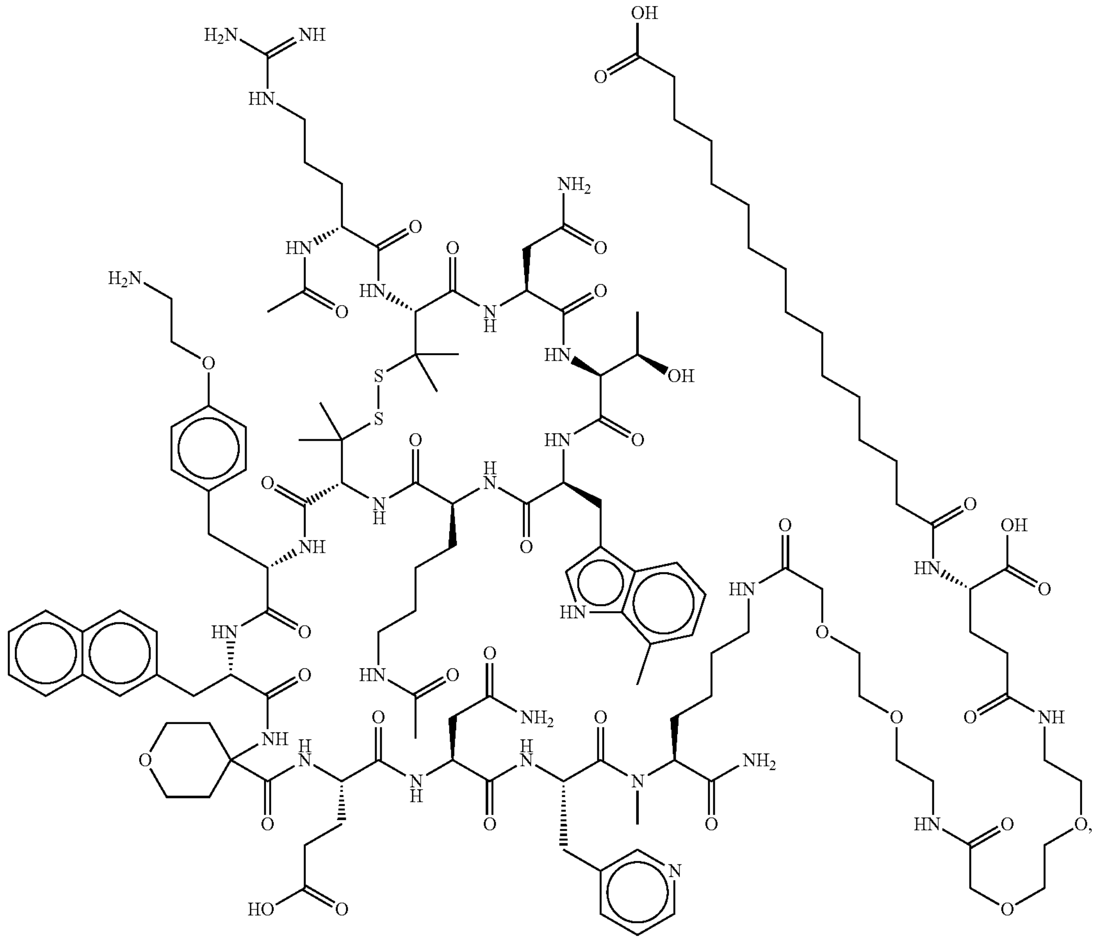
or a pharmaceutically acceptable salt thereof.

12. The interleukin-23 receptor inhibitor of claim 1, having the following structure:
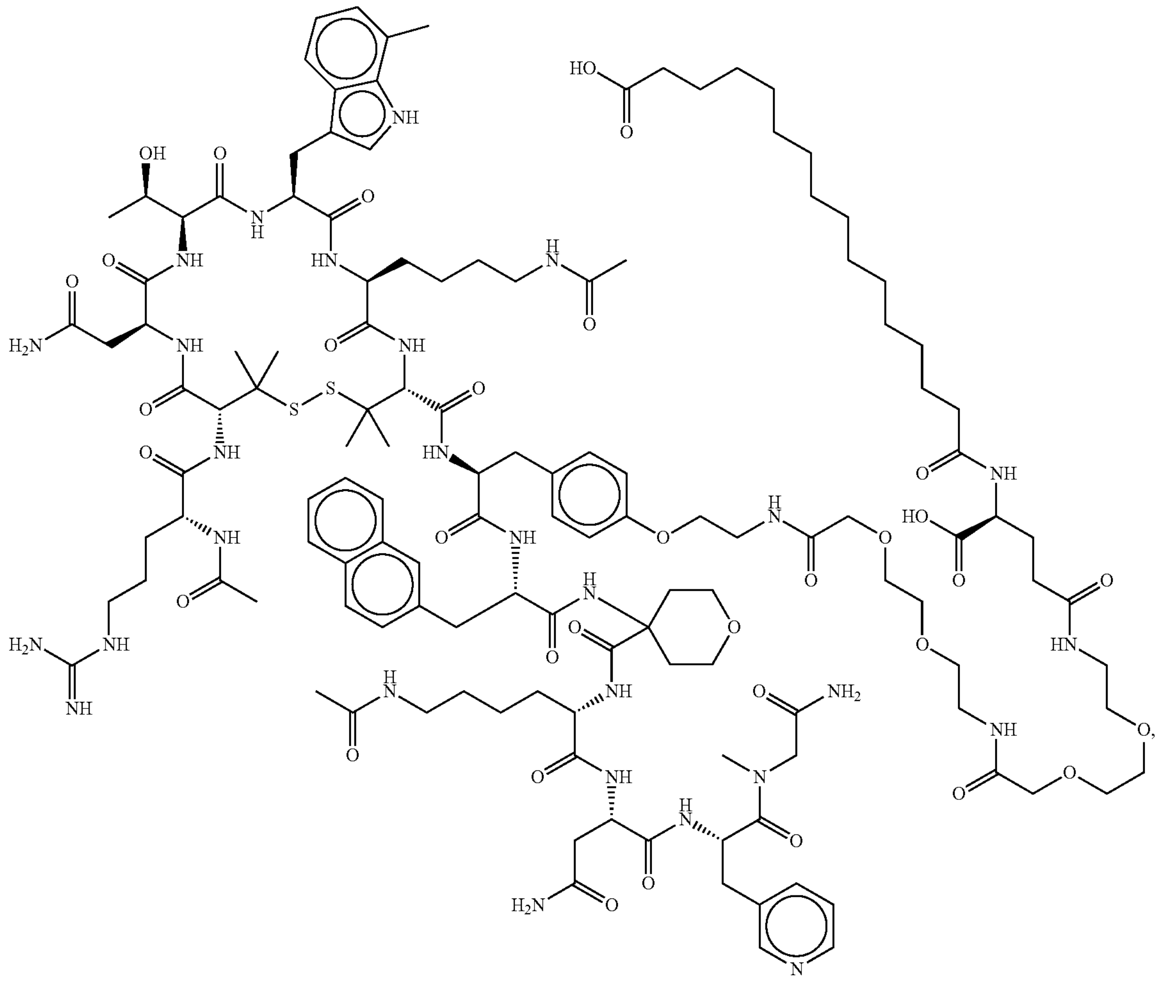
or a pharmaceutically acceptable salt thereof.

13. The interleukin-23 receptor inhibitor of claim 1, having the following structure:
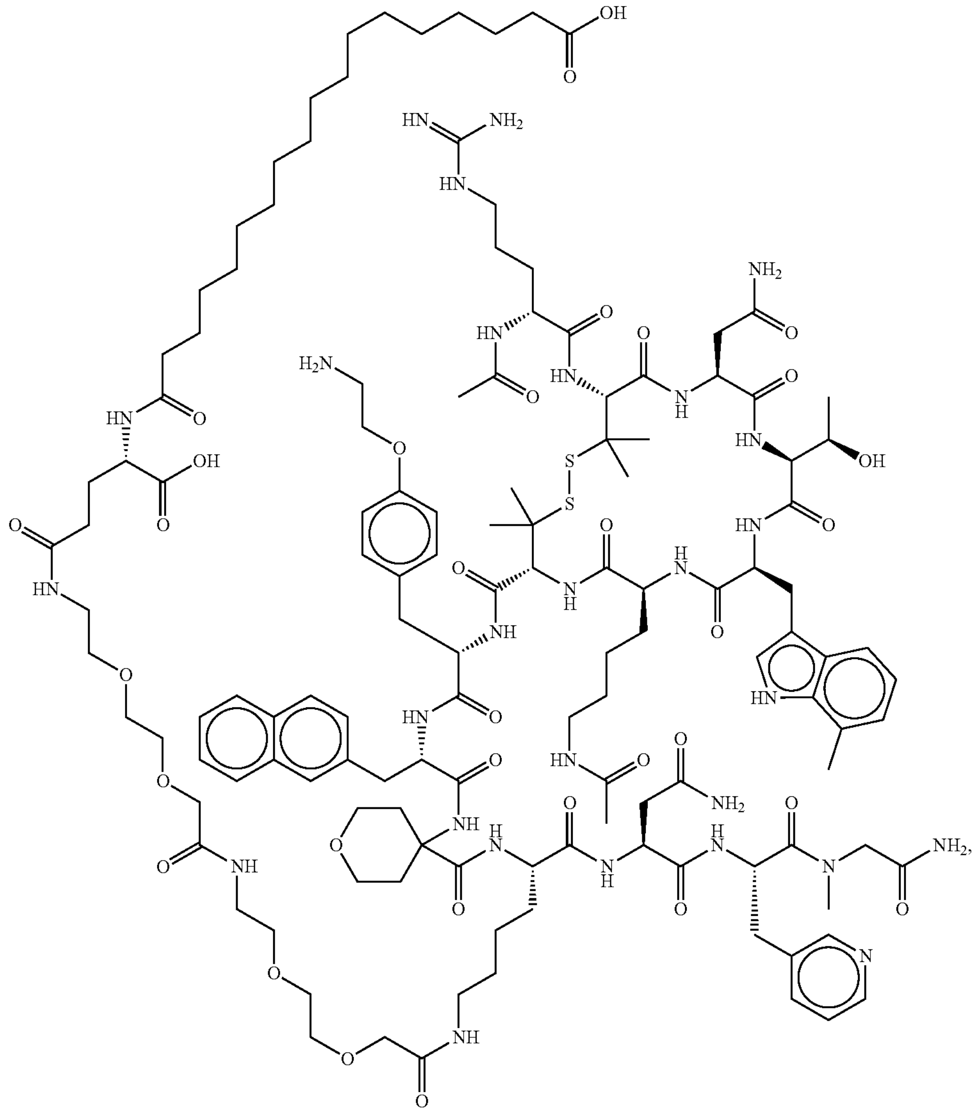
or a pharmaceutically acceptable salt thereof.

14. The interleukin-23 receptor inhibitor of claim 1, having the following structure:
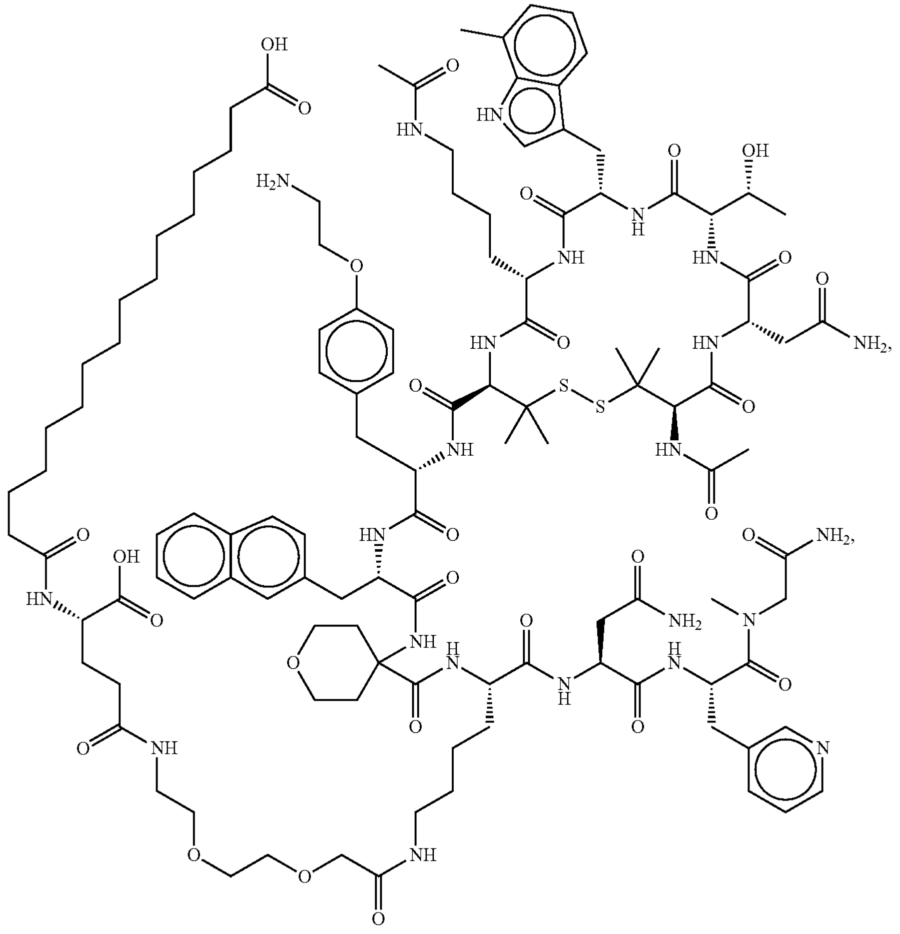
or a pharmaceutically acceptable salt thereof.

15. The interleukin-23 receptor inhibitor of claim 1, having the following structure:
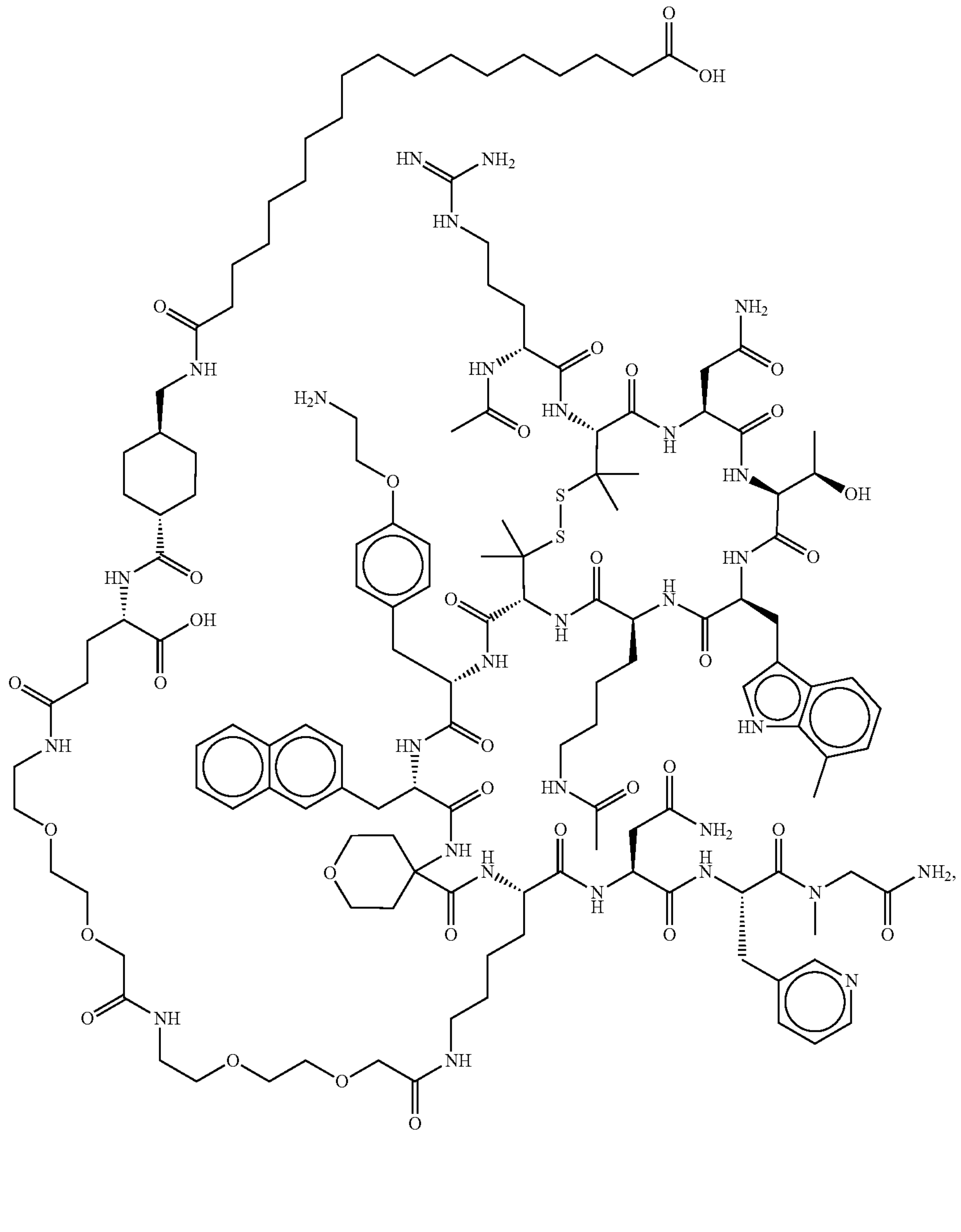
or a pharmaceutically acceptable salt thereof.

16. The interleukin-23 receptor inhibitor of claim 1, having the following structure:
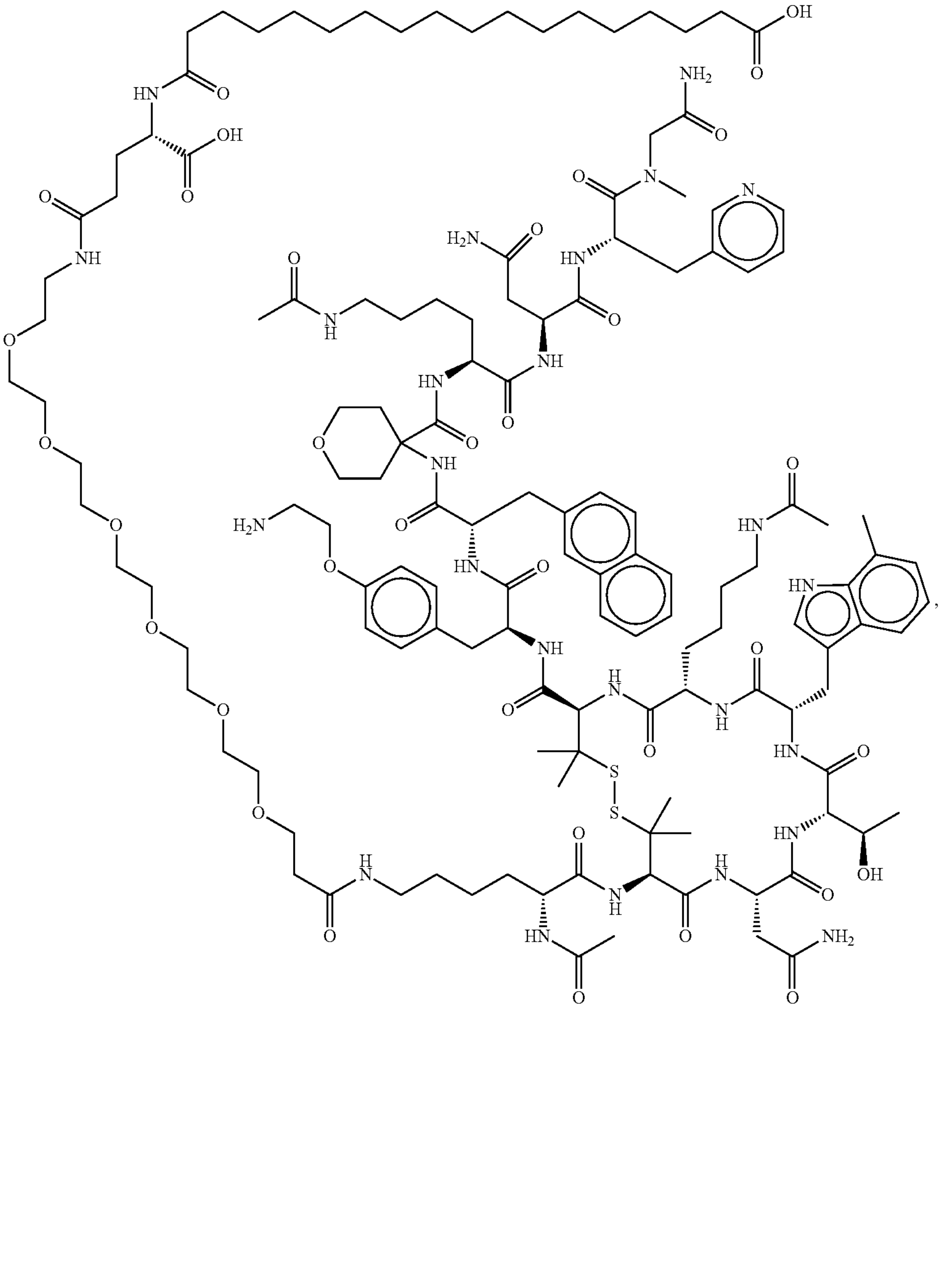
or a pharmaceutically acceptable salt thereof.

17. The interleukin-23 receptor inhibitor of claim 1, having the following structure:
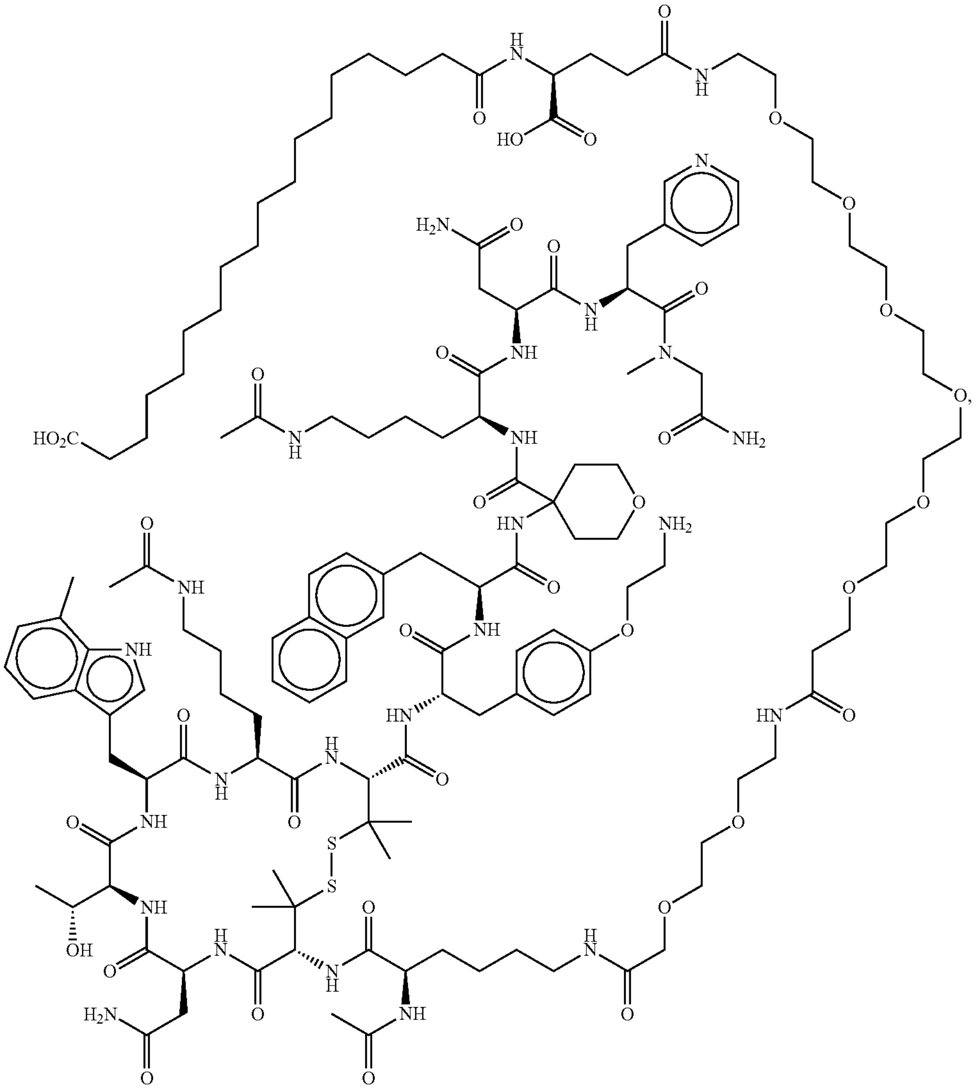
or a pharmaceutically acceptable salt thereof.

18. The interleukin-23 receptor inhibitor of claim 1, having the following structure:
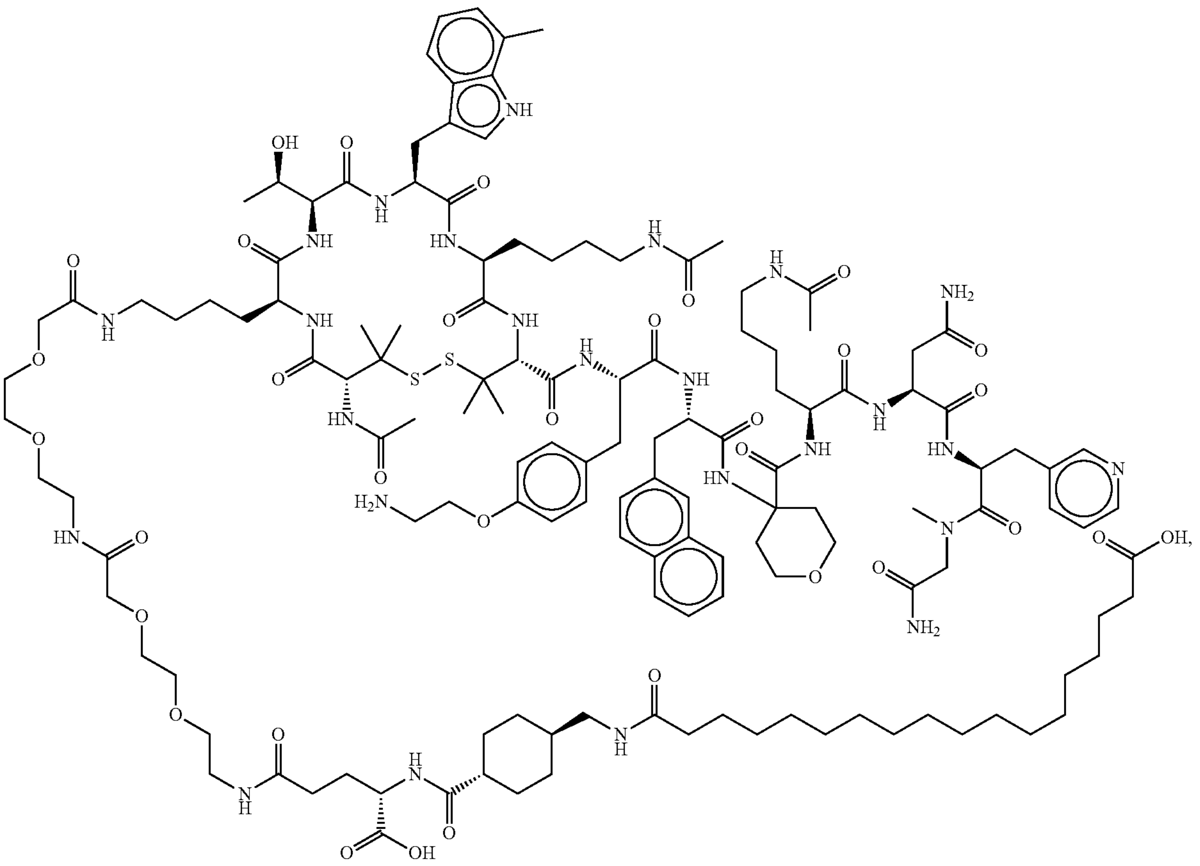
or a pharmaceutically acceptable salt thereof.
19. The interleukin-23 receptor inhibitor of claim 1, having the following structure:
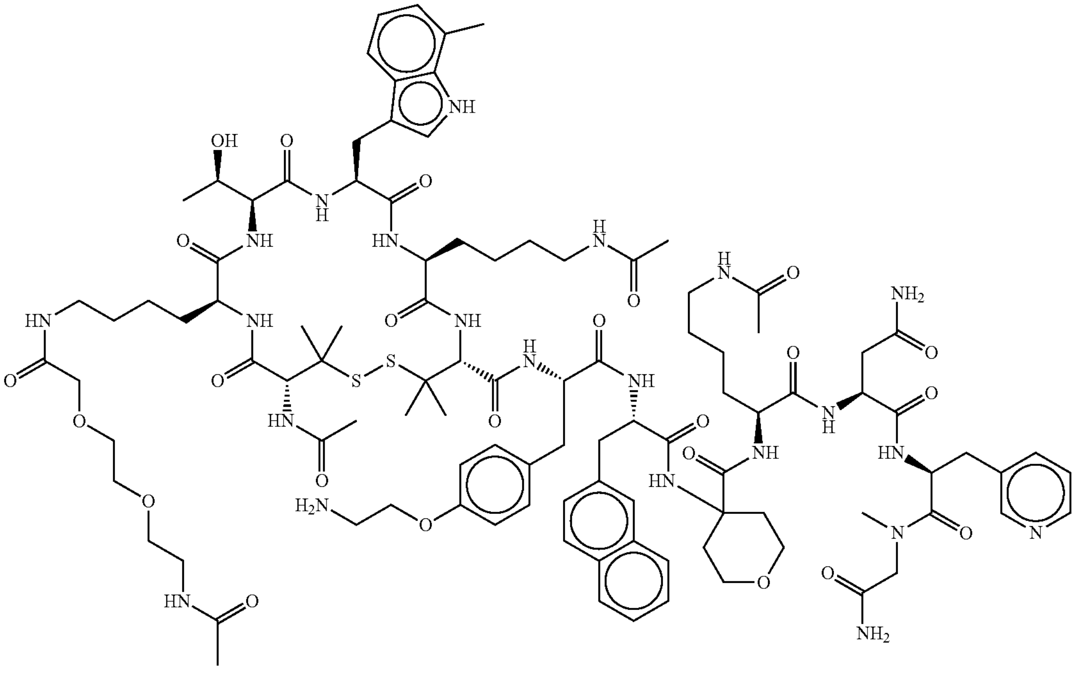

-continued
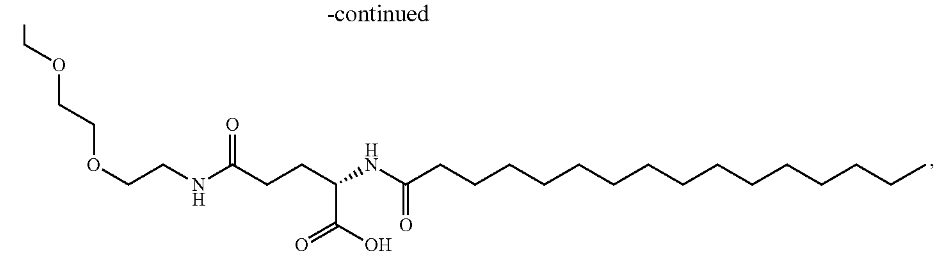
or a pharmaceutically acceptable salt thereof.
20. The interleukin-23 receptor inhibitor of claim 1, having the following structure:
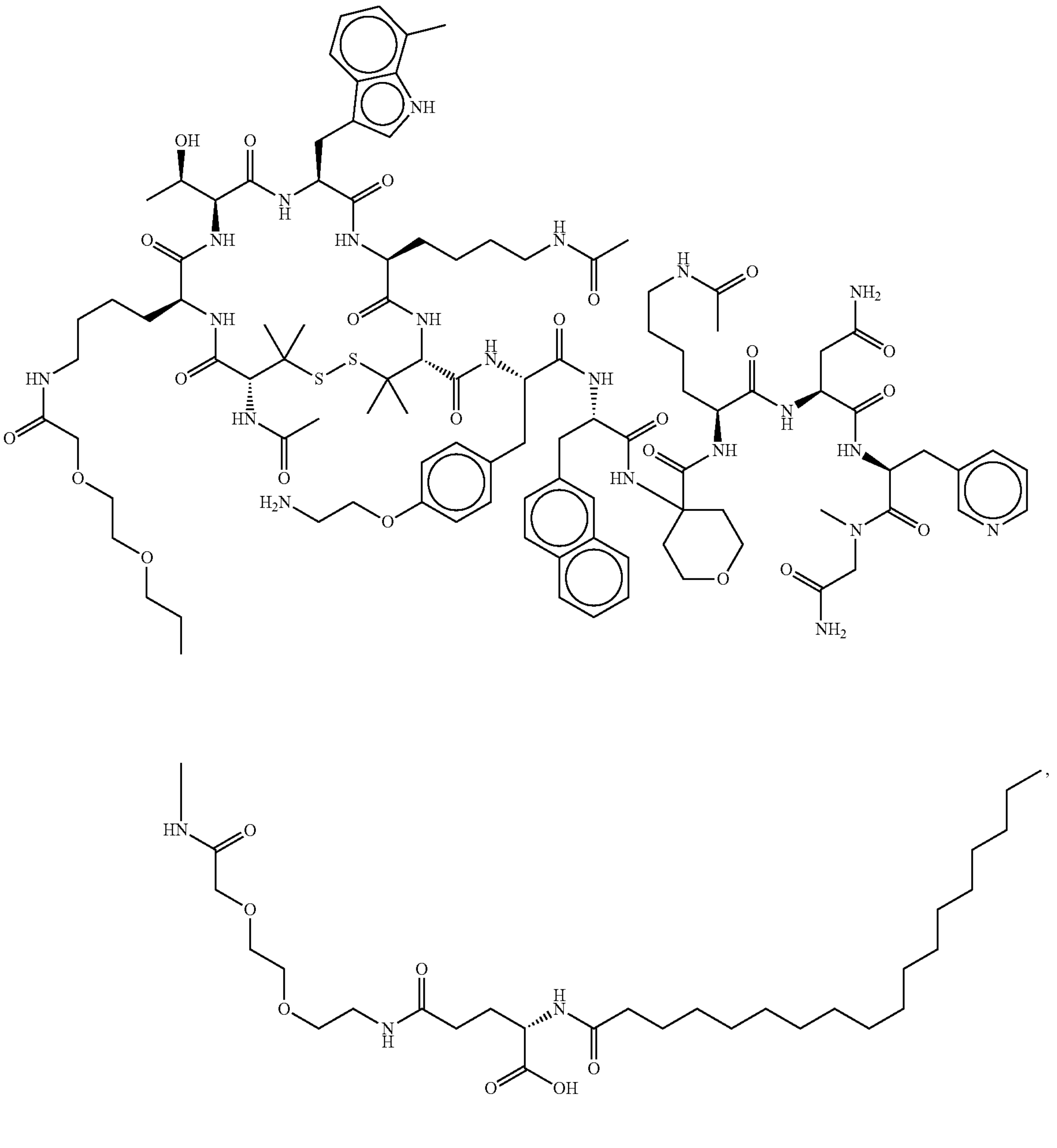
or a pharmaceutically acceptable salt thereof.

21. The interleukin-23 receptor inhibitor of claim 1, having the following structure:
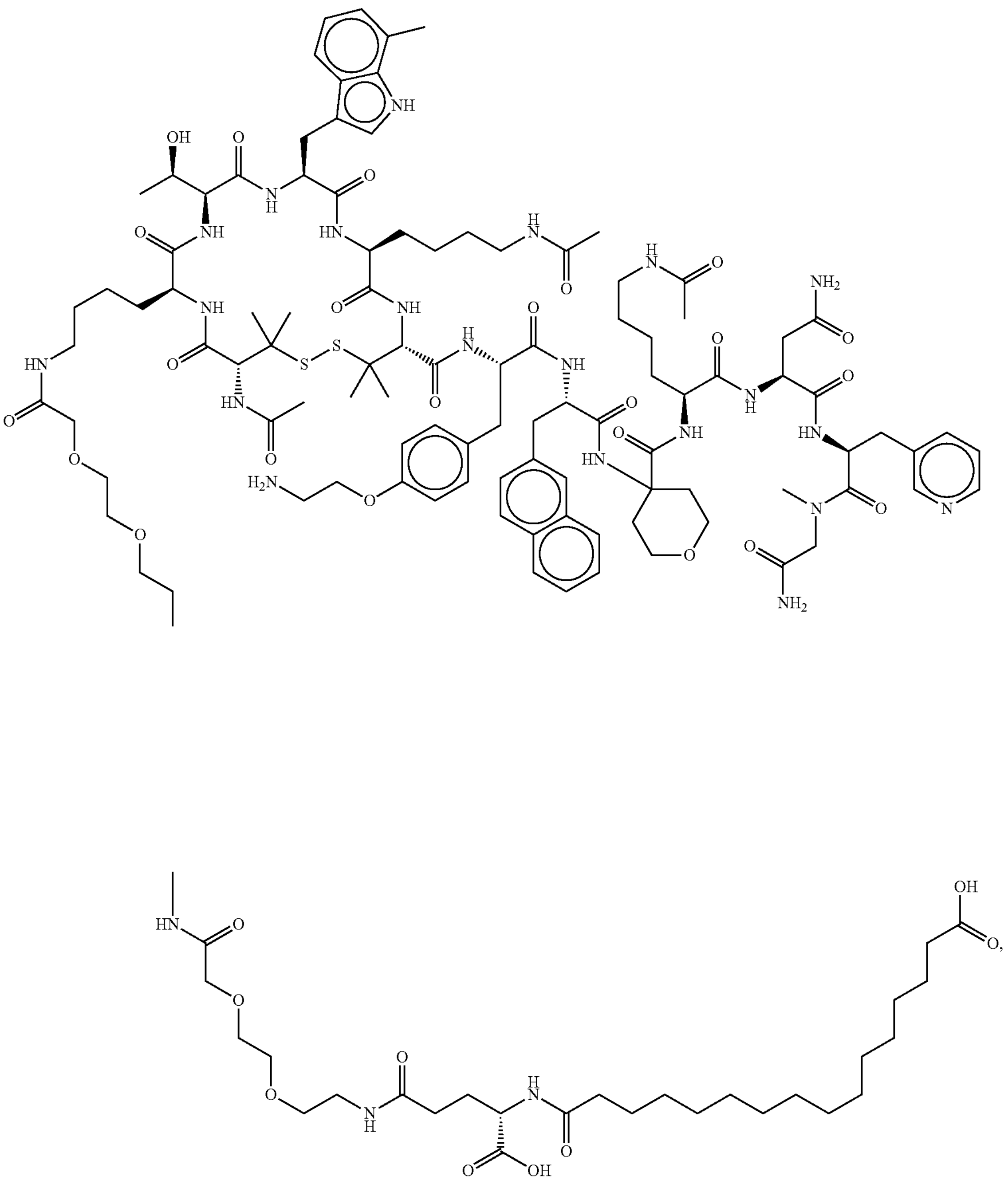
or a pharmaceutically acceptable salt thereof.

22. The interleukin-23 receptor inhibitor of claim 1, having the following structure:
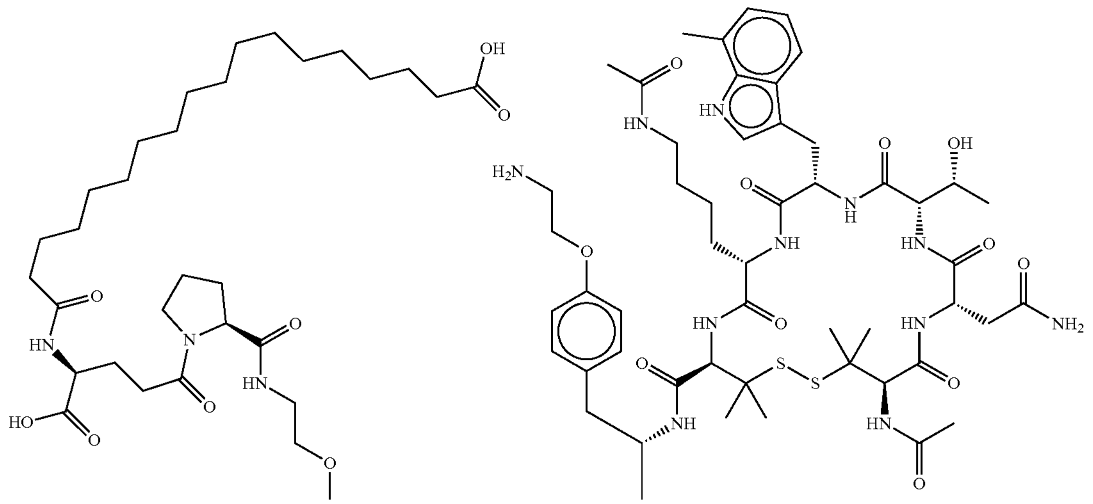
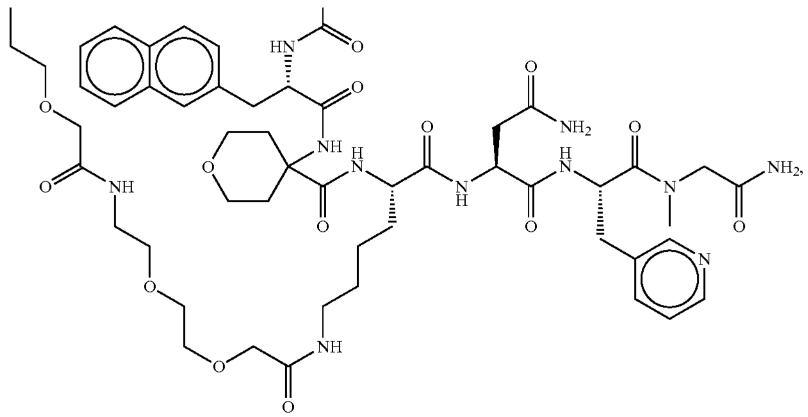
or a pharmaceutically acceptable salt thereof.

23. The interleukin-23 receptor inhibitor of claim 1, having the following structure:

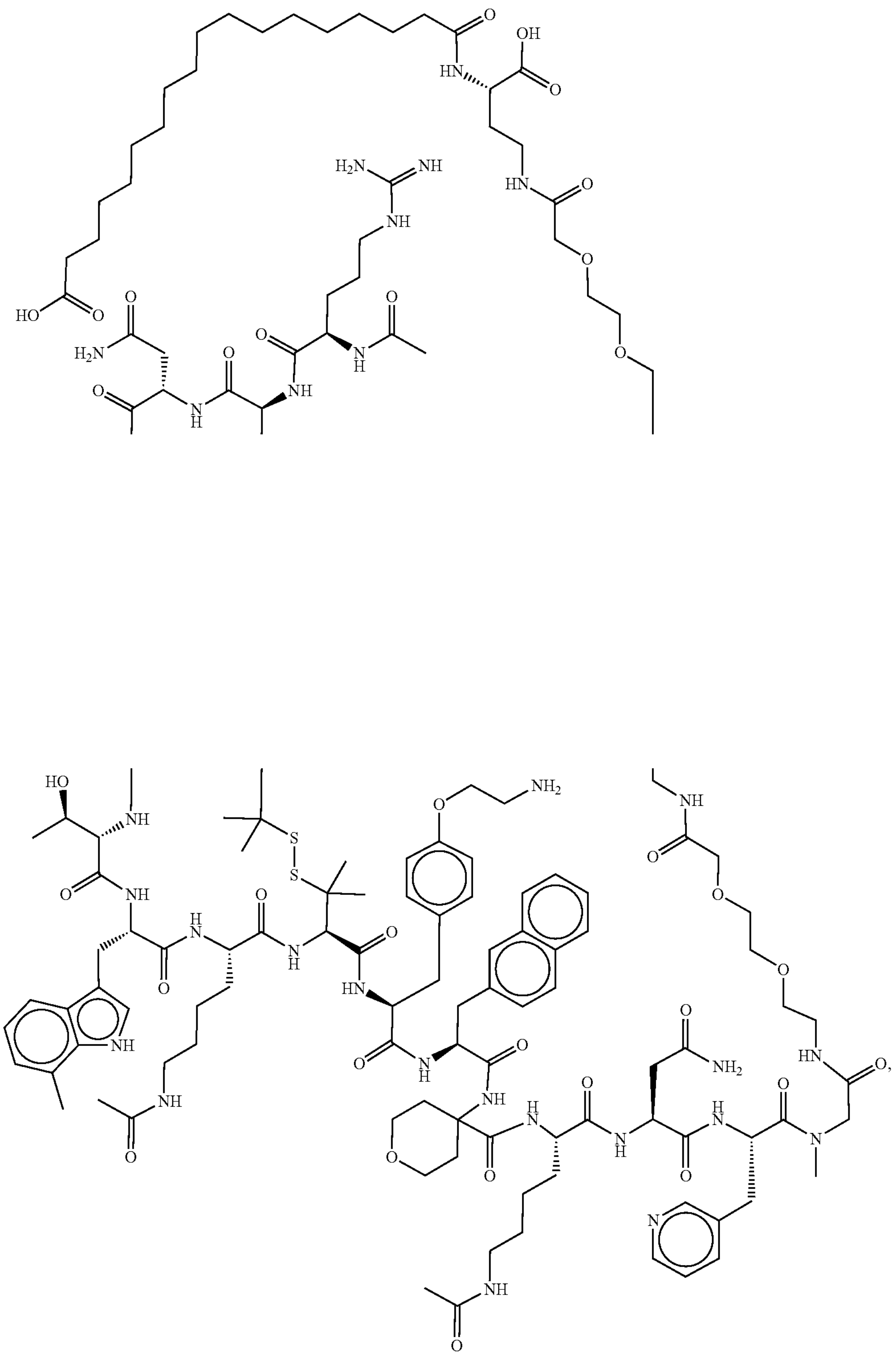

or a pharmaceutically acceptable salt thereof.

24. A pharmaceutical composition comprising:

(i) the interleukin-23 receptor inhibitor of claim 1, or a pharmaceutically acceptable salt thereof, and (ii) a pharmaceutically acceptable carrier, excipient, or diluent.

25. A method for treating a disease or disorder associated with interleukin 23 (IL-23)/interleukin 23 receptor (IL-23R), said method comprising administering an effective amount of the interleukin-23 receptor inhibitor of claim 1, or a pharmaceutically acceptable salt thereof, to a patient in need thereof.

26. A method for treating inflammatory bowel diseases (IBDs), said method comprising administering an effective amount of the interleukin-23 receptor inhibitor of claim 1, or a pharmaceutically acceptable salt thereof, to a patient in need thereof.

27. A method for treating ulcerative colitis (UC), said method comprising administering an effective amount of the interleukin-23 receptor inhibitor of claim 1, or a pharmaceutically acceptable salt thereof, to a patient in need thereof.

28. A method for treating Crohn's disease (CD), said method comprising administering an effective amount of the interleukin-23 receptor inhibitor of claim 1, or a pharmaceutically acceptable salt thereof, to a patient in need thereof.

29. A method for treating psoriasis (PsO), said method comprising administering an effective amount of the interleukin-23 receptor inhibitor of claim 1, or a pharmaceutically acceptable salt thereof, to a patient in need thereof.

30. A method for treating psoriatic arthritis (PsA), said method comprising administering an effective amount of the interleukin-23 receptor inhibitor of claim 1, or a pharmaceutically acceptable salt thereof, to a patient in need thereof.

31. The interleukin-23 receptor inhibitor of claim 1, having the following structure:

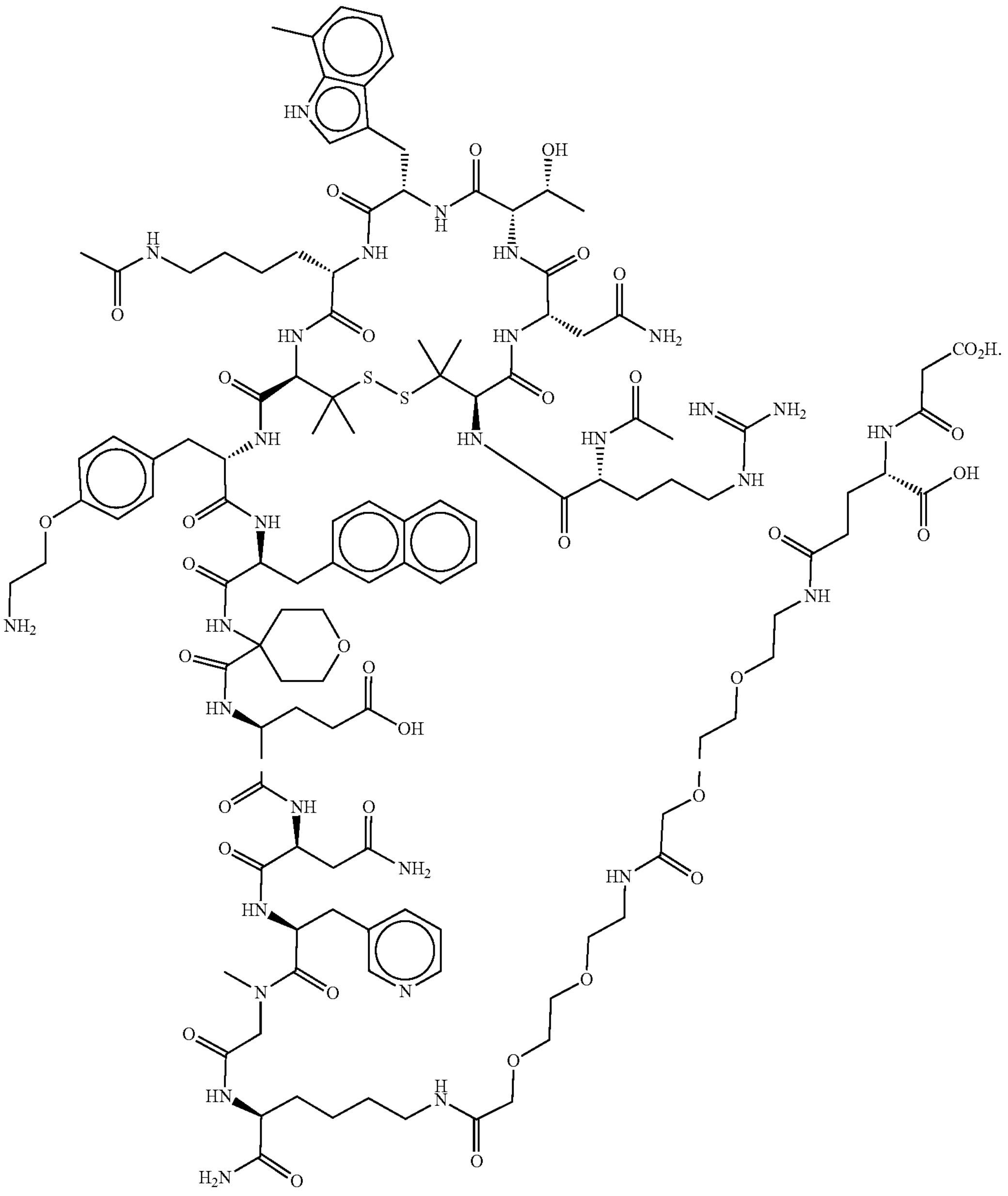

32. The interleukin-23 receptor inhibitor of claim 1, having the following structure:
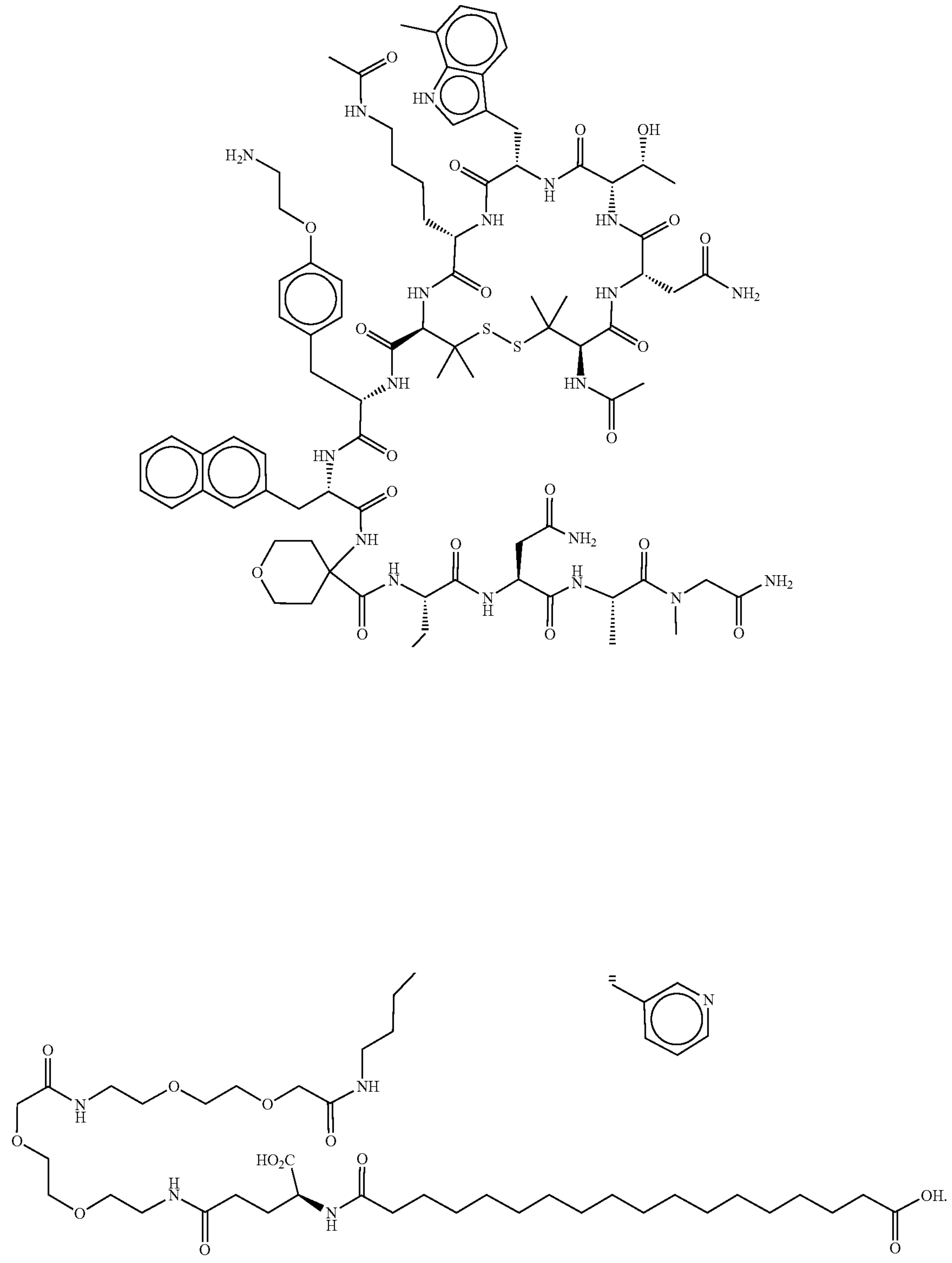

33. The interleukin-23 receptor inhibitor of claim 1, having the following structure:
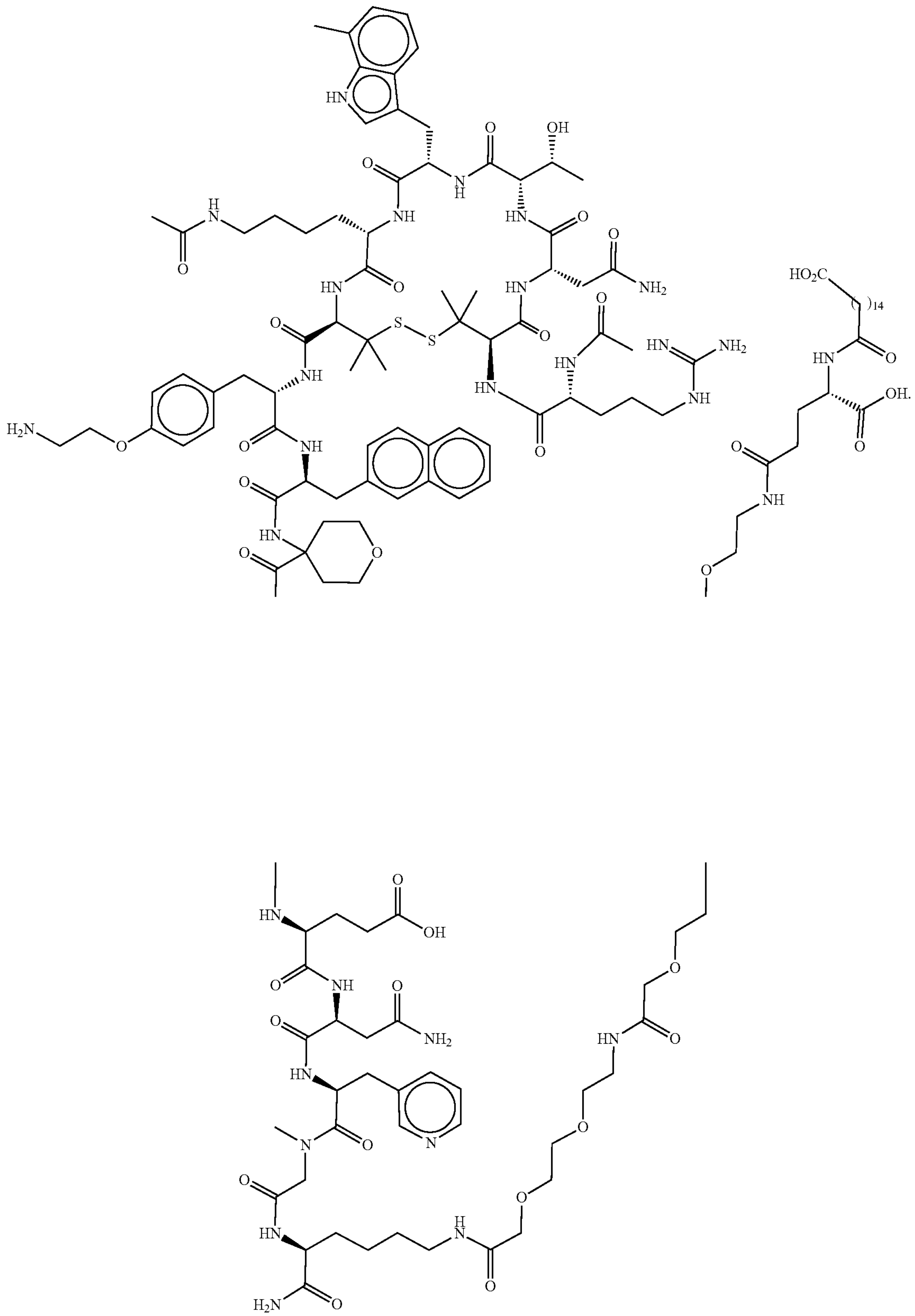

34. The interleukin-23 receptor inhibitor of claim 1, having the following structure:
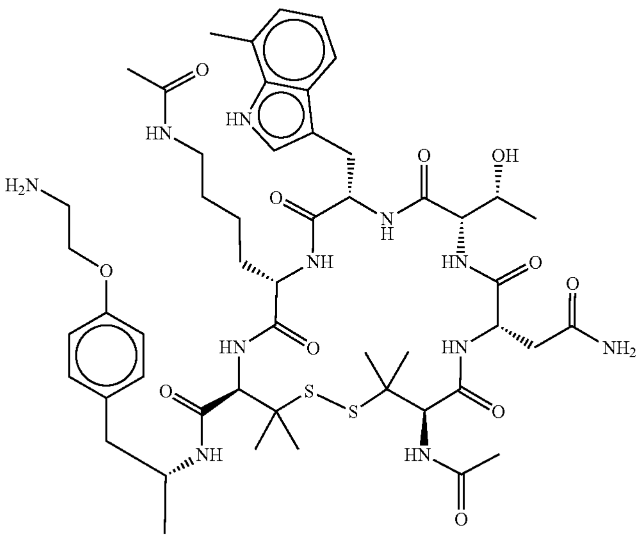
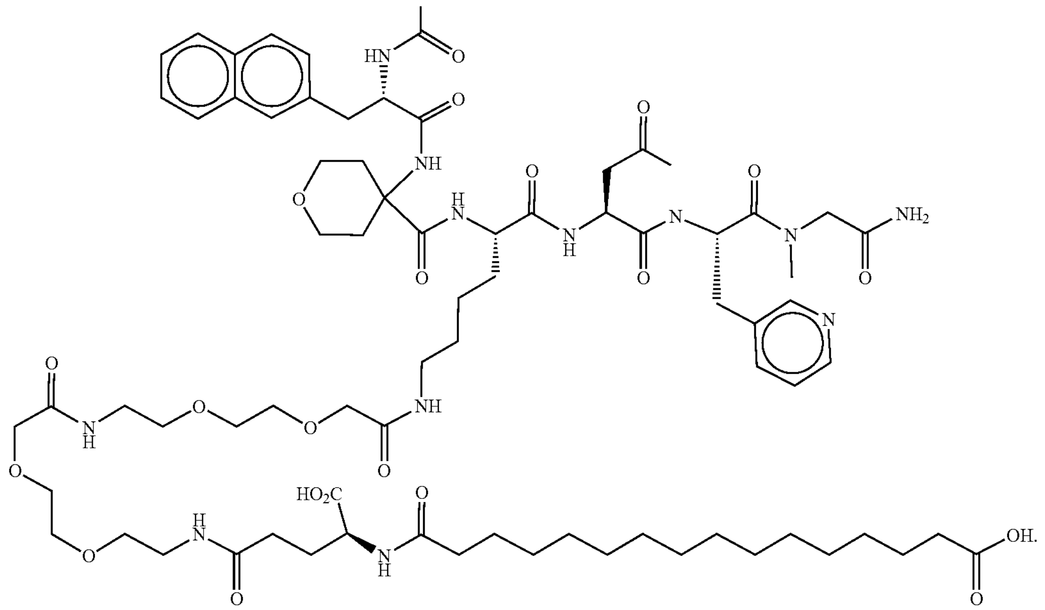

35. The interleukin-23 receptor inhibitor of claim 1, having the following structure:
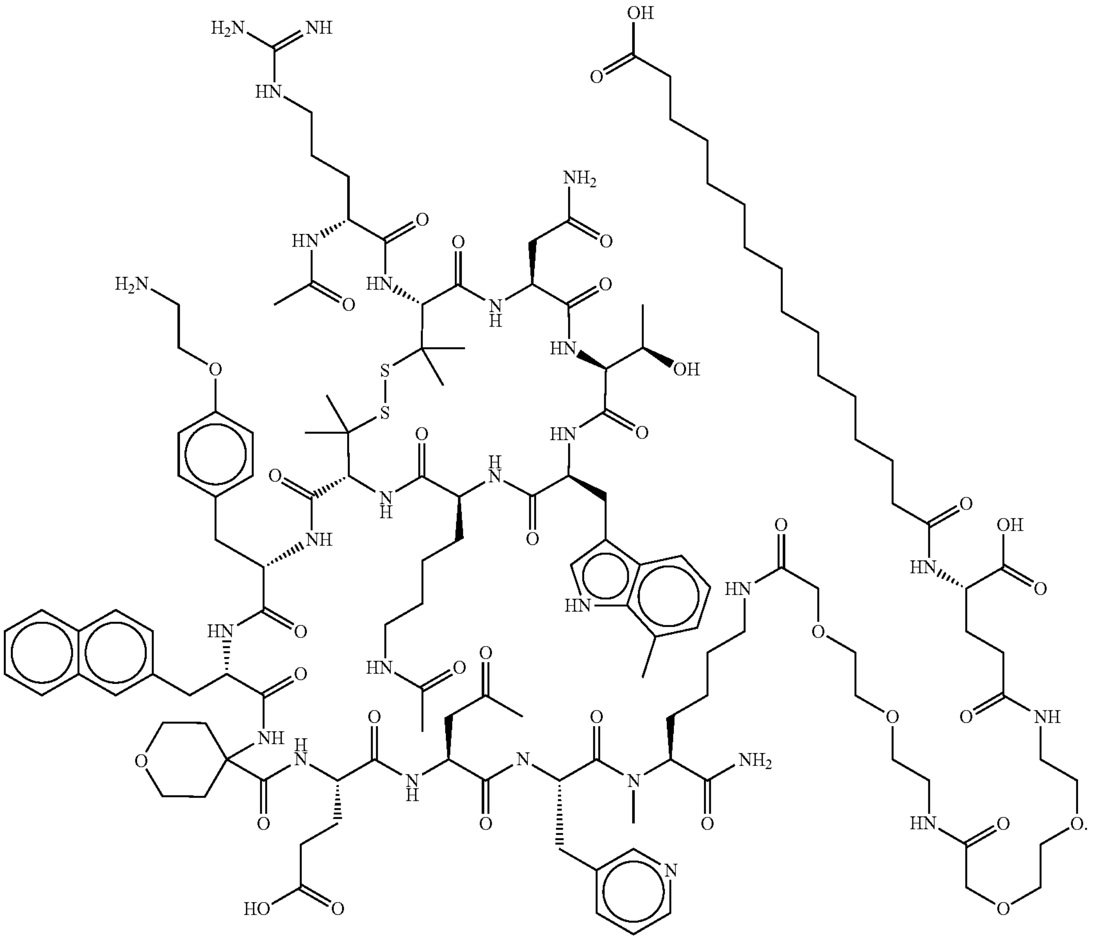
36. The interleukin-23 receptor inhibitor of claim 1, having the following structure:
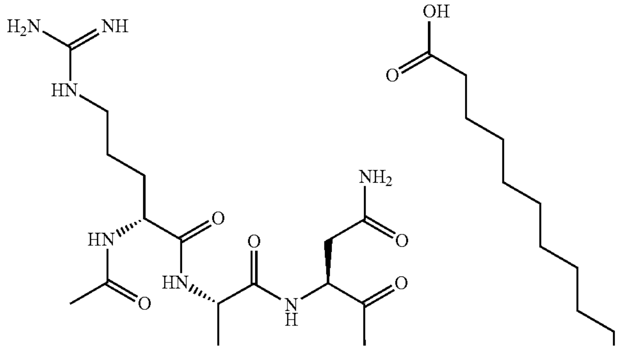

-continued
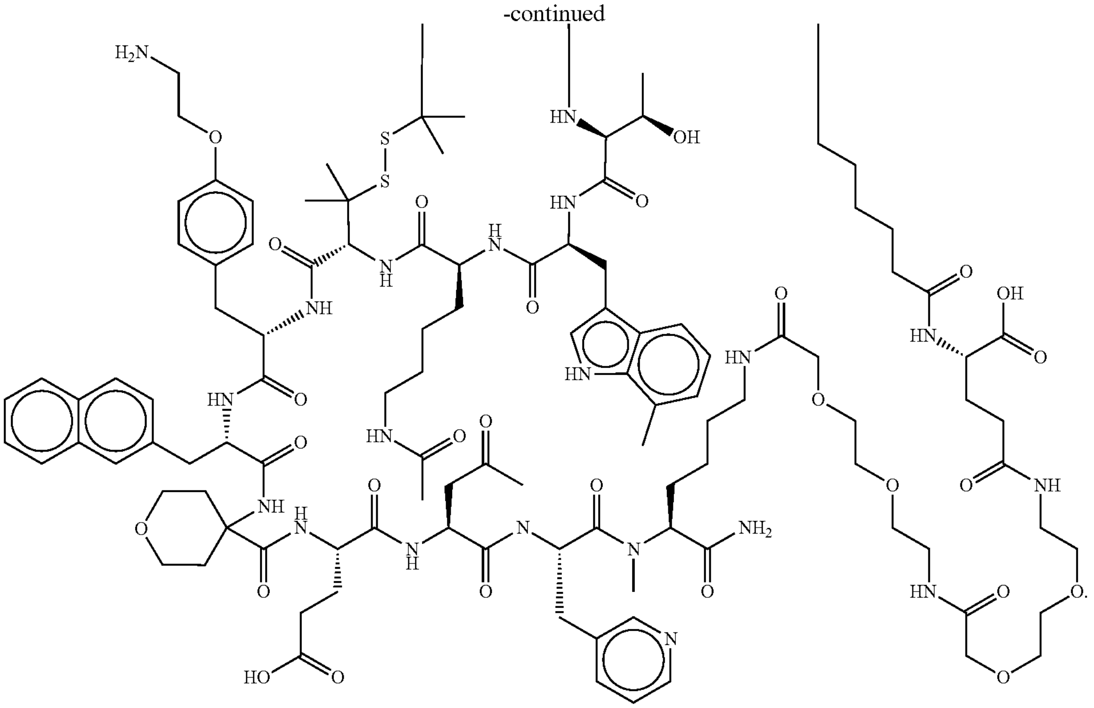
37. The interleukin-23 receptor inhibitor of claim 1, having the following structure:
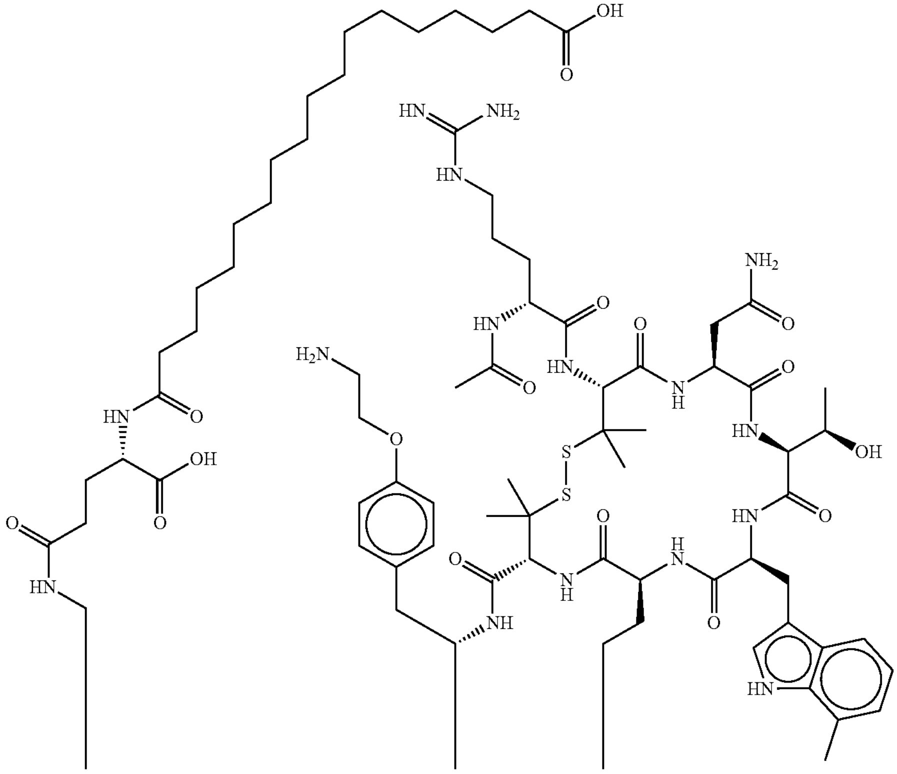

-continued
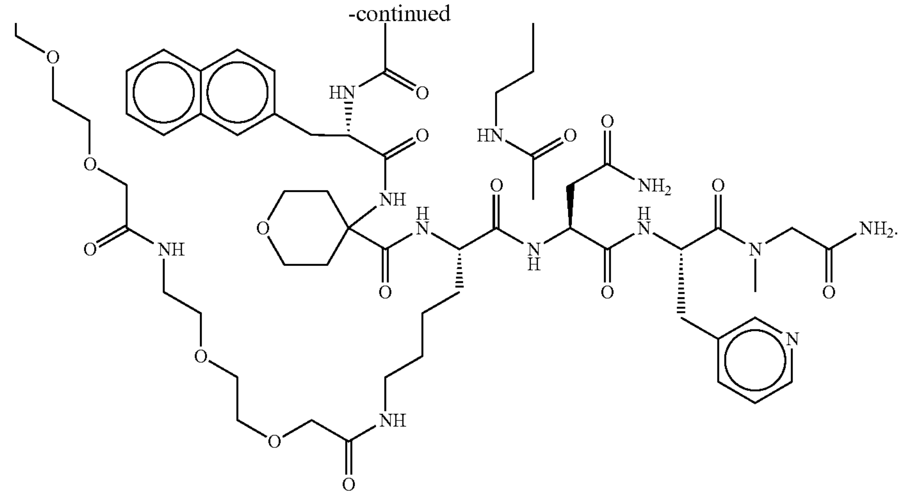
38. The interleukin-23 receptor inhibitor of claim 1, having the following structure:
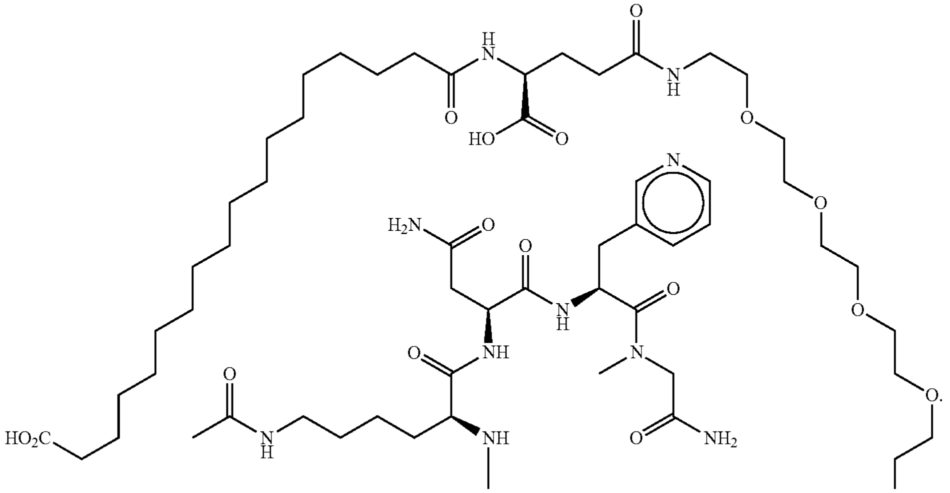

-continued
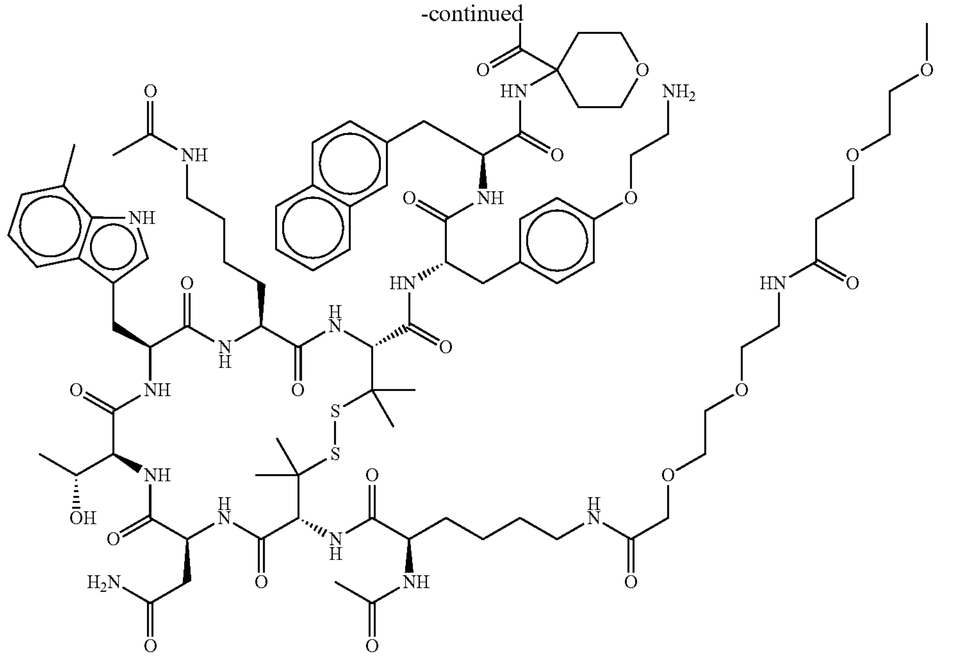
39. The interleukin-23 inhibitor of claim 1, having the following structure:
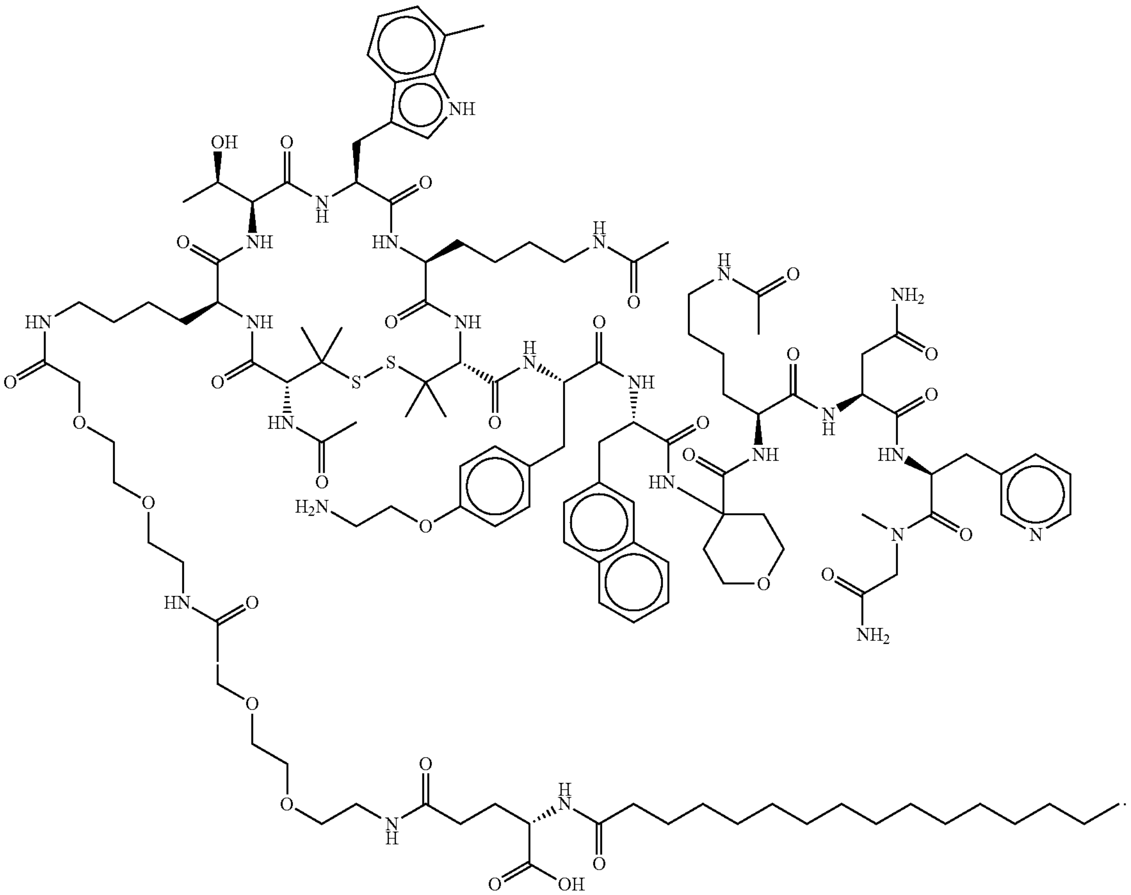

40. The interleukin-23 receptor inhibitor of claim 6, having the following structure:
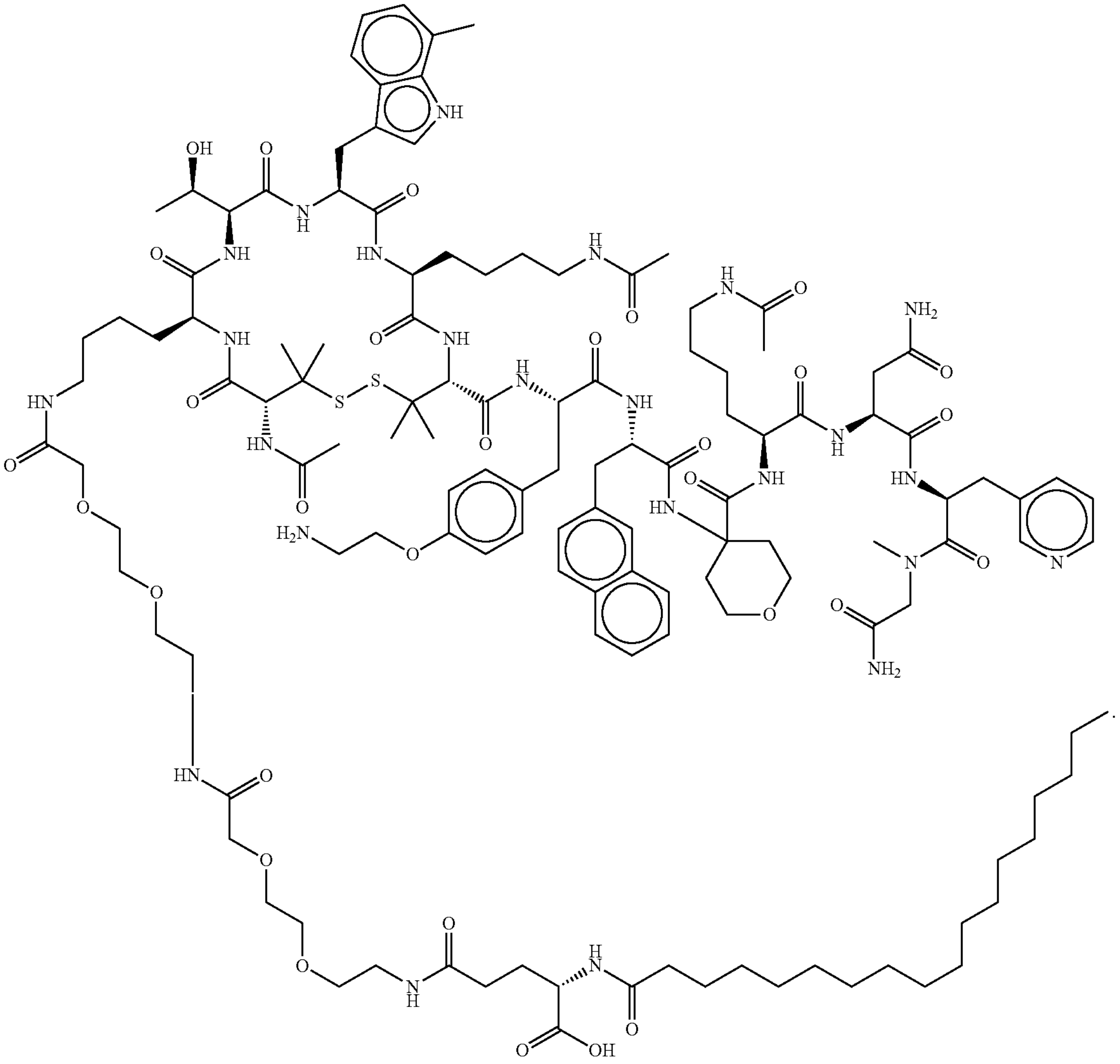
* * * * *